United States Patent 12,569,549 (FLAVIVIRUS VACCINE) - sequence listing, part 51

SEQ ID NO: 18337 - RNA, 9867 nt, synthetic construct
  misc_feature 1..9867: note = derived and/or modified CDS sequence (opt4) from DENV-4__FJ024424__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccaccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccacccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacatgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18338 - RNA, 9867 nt, synthetic construct
  misc_feature 1..9867: note = derived and/or modified CDS sequence (opt4) from DENV-4__EU854295__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccccggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagagtggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18339 - RNA, 9867 nt, synthetic construct
  misc_feature 1..9867: note = derived and/or modified CDS sequence (opt4) from DENV-4__EU854296__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgccaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggccaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccatcggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacagacccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18340 - RNA, 9867 nt, synthetic construct
  misc_feature 1..9867: note = derived and/or modified CDS sequence (opt4) from DENV-4__GQ199878__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18341 - RNA, 9867 nt, synthetic construct
  misc_feature 1..9867: note = derived and/or modified CDS sequence (opt4) from DENV-4__GQ199879__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagaccaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18342 - RNA, 9867 nt, synthetic construct
  misc_feature 1..9867: note = derived and/or modified CDS sequence (opt4) from DENV-4__GQ199880__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagaccaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18343 - RNA, 9867 nt, synthetic construct
  misc_feature 1..9867: note = derived and/or modified CDS sequence (opt4) from DENV-4__GQ252675__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaagatcagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatgctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagaccgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagaccaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18344 - RNA, 9867 nt, synthetic construct
  misc_feature 1..9867: note = derived and/or modified CDS sequence (opt4) from DENV-4__FJ810417__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcatccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagaccaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18345 - RNA, 9867 nt, synthetic construct
  misc_feature 1..9867: note = derived and/or modified CDS sequence (opt4) from DENV-4__FJ850057__SS-prME
  source 1..9867: mol_type = other RNA
agcaccatcaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccaccctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagaccaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18346 - RNA, 9867 nt, synthetic construct
  misc_feature 1..9867: note = derived and/or modified CDS sequence (opt4) from DENV-4__GQ199881__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccagaatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcttcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatgatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcagcagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18347 - RNA, 9867 nt, synthetic construct
  misc_feature 1..9867: note = derived and/or modified CDS sequence (opt4) from DENV-4__GQ199882__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggcagcgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18348 - RNA, 9867 nt, synthetic construct
  misc_feature 1..9867: note = derived and/or modified CDS sequence (opt4) from DENV-4__GQ199883__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgccgaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18349 - RNA, 9867 nt, synthetic construct
  misc_feature 1..9867: note = derived and/or modified CDS sequence (opt4) from DENV-4__GQ199884__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18350 - RNA, 9867 nt, synthetic construct
  misc_feature 1..9867: note = derived and/or modified CDS sequence (opt4) from DENV-4__FJ882595__SS-prME
  source 1..9867: mol_type = other RNA
agcaccatcaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaccggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18351 - RNA, 9867 nt, synthetic construct
  misc_feature 1..9867: note = derived and/or modified CDS sequence (opt4) from DENV-4__FJ882596__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgagaggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18352 - RNA, 9867 nt, synthetic construct
  misc_feature 1..9867: note = derived and/or modified CDS sequence (opt4) from DENV-4__FJ850059__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgtgtgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgatcgcccacaaggacggcgtgtgcggcatcagaagcaccaccagactggagaacgtgatgtggaagcagatcaccaacgagctgaactacgtgctgtgggagggcggccacgacctgaccgtggtggccggcgacgccaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacagacccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18353 - RNA, 9867 nt, synthetic construct
  misc_feature 1..9867: note = derived and/or modified CDS sequence (opt4) from DENV-4__FJ882598__SS-prME
  source 1..9867: mol_type = other RNA
agcaccatcaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18354 - RNA, 9867 nt, synthetic construct
  misc_feature 1..9867: note = derived and/or modified CDS sequence (opt4) from DENV-4__FJ882601__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcgtgaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggagaagaccgagaccaccatcctggacgtggacctgagacccgccagcgcctggaccctgtacgccgtggccaccaccatcctgacccccatgctgagacacaccatcgagaacaccagcgccaacctgagcctgaccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggccctgaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgtgcagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctggtgaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18355 - RNA, 9867 nt, synthetic construct
  misc_feature 1..9867: note = derived and/or modified CDS sequence (opt4) from DENV-4__FJ226067__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaagaggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcaccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgccctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgccctgagcgagagcgagggcgtgctgtga

SEQ ID NO: 18356 - RNA, 9867 nt, synthetic construct
  misc_feature 1..9867: note = derived and/or modified CDS sequence (opt4) from DENV-4__EU854299__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18357 - RNA, 9867 nt, synthetic construct
  misc_feature 1..9867: note = derived and/or modified CDS sequence (opt4) from DENV-4__FJ182016__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgagaggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacagaatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18358 - RNA, 9867 nt, synthetic construct
  misc_feature 1..9867: note = derived and/or modified CDS sequence (opt4) from DENV-4__EU854300__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgagaccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatcgagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaacctggcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaaggccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18359 - RNA, 9867 nt, synthetic construct
  misc_feature 1..9867: note = derived and/or modified CDS sequence (opt4) from DENV-4__FJ182017__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggccctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18360 - RNA, 9867 nt, synthetic construct
  misc_feature 1..9867: note = derived and/or modified CDS sequence (opt4) from DENV-4__EU854301__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccagatcttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatgggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgttcctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccagcgagagcgagggcgtgctgtga

SEQ ID NO: 18361 - RNA, 9867 nt, synthetic construct
  misc_feature 1..9867: note = derived and/or modified CDS sequence (opt4) from DENV-4__FJ639736__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18362 - RNA, 9867 nt, synthetic construct
  misc_feature 1..9867: note = derived and/or modified CDS sequence (opt4) from DENV-4__FJ639737__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctgatcaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacgacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccagcgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatcgagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccatcgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18363 - RNA, 9867 nt, synthetic construct
  misc_feature 1..9867: note = derived and/or modified CDS sequence (opt4) from DENV-4__FJ639738__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaagactgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccgtggagcccggcaagaaccccaagcacgtgcagaccaagcccggcctgttcaagaccatcaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18364 - RNA, 9867 nt, synthetic construct
  misc_feature 1..9867: note = derived and/or modified CDS sequence (opt4) from DENV-4__FJ639739__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctggccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaagatcgtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggctgcccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18365 - RNA, 9867 nt, synthetic construct
  misc_feature 1..9867: note = derived and/or modified CDS sequence (opt4) from DENV-4__JN819409__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccgccacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacggcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtgatcatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccaaggaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18366 - RNA, 9867 nt, synthetic construct
  misc_feature 1..9867: note = derived and/or modified CDS sequence (opt4) from DENV-4__FJ639742__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatggtgggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccagcgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18367 - RNA, 9867 nt, synthetic construct
  misc_feature 1..9867: note = derived and/or modified CDS sequence (opt4) from DENV-4__FJ639745__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcgccaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18368 - RNA, 9867 nt, synthetic construct
  misc_feature 1..9867: note = derived and/or modified CDS sequence (opt4) from DENV-4__FJ850095__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18369 - RNA, 9867 nt, synthetic construct
  misc_feature 1..9867: note = derived and/or modified CDS sequence (opt4) from DENV-4__FJ639748__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgcagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcctgctggtgctgtggatcggcaccaacagcagaaacaccagcatggccatgacctgcatcgccgtgggcggcatcaccctgttcctgggcttcaccgtgcaggccgacgtgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagagcaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcgccaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagaacgagggcgtgctgtga

SEQ ID NO: 18370 - RNA, 9867 nt, synthetic construct
  misc_feature 1..9867: note = derived and/or modified CDS sequence (opt4) from DENV-4__FJ639764__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcaccaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggatcgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagaaccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaagactgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccgtggagcccggcaagaaccccaagcacgtgcagaccaagcccggcctgttcaagaccatcaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18371 - RNA, 9867 nt, synthetic construct
  misc_feature 1..9867: note = derived and/or modified CDS sequence (opt4) from DENV-4__FJ639773__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagagactgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccaccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggagaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18372 - RNA, 9867 nt, synthetic construct
  misc_feature 1..9867: note = derived and/or modified CDS sequence (opt4) from DENV-4__FJ882580__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagagagtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccatcgtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18373 - RNA, 9867 nt, synthetic construct
  misc_feature 1..9867: note = derived and/or modified CDS sequence (opt4) from DENV-4__FJ882581__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaacctggcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18374 - RNA, 9867 nt, synthetic construct
  misc_feature 1..9867: note = derived and/or modified CDS sequence (opt4) from DENV-4__FJ882582__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaacctggcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgccgactacatgcccgtgatgaagagatacagcgcccccagcgagagcgagggcgtgctgtga

SEQ ID NO: 18375 - RNA, 9867 nt, synthetic construct
  misc_feature 1..9867: note = derived and/or modified CDS sequence (opt4) from DENV-4__FJ882584__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18376 - RNA, 9867 nt, synthetic construct
  misc_feature 1..9867: note = derived and/or modified CDS sequence (opt4) from DENV-4__FJ882585__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccaccatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgccatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccaaggaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18377 - RNA, 9867 nt, synthetic construct
  misc_feature 1..9867: note = derived and/or modified CDS sequence (opt4) from DENV-4__FJ882586__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcgcccaggtgagaaacctgatcggcaaggaggagtacgtggactacatgcccgtgatgaagagatacagcgcccccagcgagagcgagggcgtgctgtga

SEQ ID NO: 18378 - RNA, 9867 nt, synthetic construct
  misc_feature 1..9867: note = derived and/or modified CDS sequence (opt4) from DENV-4__JN819406__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcgccagagagctgaagtgcggcagcggcatcttcgtggtggacaacgtgcacacctggaccgagcagtaccagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18379 - RNA, 9867 nt, synthetic construct
  misc_feature 1..9867: note = derived and/or modified CDS sequence (opt4) from DENV-4__GQ199876__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtgatcggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccgtgagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18380 - RNA, 9867 nt, synthetic construct
  misc_feature 1..9867: note = derived and/or modified CDS sequence (opt4) from DENV-4__KP723482__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcaacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccttctgcgccatcatcctgggcggcctgacctggatggacctgctgagagtgctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccagcgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagcccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcaccaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccgtgatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18381 - RNA, 9867 nt, synthetic construct
  misc_feature 1..9867: note = derived and/or modified CDS sequence (opt4) from DENV-4__JN638570__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacggcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagccccgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccgtgcaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatgctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctggccatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgagatgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagatacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagagagacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagagtggtgatgaccaccaccgccaactggctgtggaccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgagaagatacagcgcccacttcgagagcgagggcgtgctgtga

SEQ ID NO: 18382 - RNA, 9867 nt, synthetic construct
  misc_feature 1..9867: note = derived and/or modified CDS sequence (opt4) from DENV-4__JN638571__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgagtacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacggcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccgtgcaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatgctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctggccatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgagatgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagatacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagagagacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagagtggtgatgaccaccaccgccaactggctgtggaccctgctgggcagaaagaagaaccccagactgtgcaccagagaggagttcatcagcaaggtgagactgaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgagaagatacagcgcccacttcgagagcgagggcgtgctgtga

SEQ ID NO: 18383 - RNA, 9867 nt, synthetic construct
  misc_feature 1..9867: note = derived and/or modified CDS sequence (opt4) from DENV-4__JN638572__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgagtacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacggcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcgtgttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccgtgcaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctggccatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgagatgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagaccaagcacgccgtgagcagaggcagcagcaagatcagatggatcgtggagagaggcatgatcaagcccaagggcaaggtggtggacctgggctgcggcagaggcggctggagctactacatggccaccctgcagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagatacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagagagacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagagtggtgatgaccaccaccgccaactggctgtggaccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaaggtgctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacatggactacatgcccgtgatgaagagatacagcgcccccagcgagagcgagggcgtgctgtga

SEQ ID NO: 18384 - RNA, 9867 nt, synthetic construct
  misc_feature 1..9867: note = derived and/or modified CDS sequence (opt4) from DENV-4__JX024757__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggagcgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacggcagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagtacatgatgctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgagaatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccctgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccatgaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccagaggcctgaaggagagagtggagaagtggctgaaggagtgcggcgtggacagactgaagagaatggccatcagcggcgacgactgcgtggtgaagcccatcgacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18385 - RNA, 9867 nt, synthetic construct
  misc_feature 1..9867: note = derived and/or modified CDS sequence (opt4) from DENV-4__JF741967__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcaacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccttctgcgccatcatcctgggcggcctgacctggatggacctgctgagagtgctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagaggtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccacaaggccaccctgagcgagggcgtgtacagaatcatgcagagaggcctgttcggcaagacccaggtgggcgtgggcatccacatggagggcgtgttccacaccgtgggccacgtgaccagaggcagcgtgatctgccacgagaccggcagactggagcccagctggggcgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagcccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcaccaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccgtgatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18386 - RNA, 9867 nt, synthetic construct
  misc_feature 1..9867: note = derived and/or modified CDS sequence (opt4) from DENV-4__JQ822247__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcaacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccttctgcgccatcatcctgggcggcctgacctggatggacctgctgagagtgctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagcccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcaccaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccgtgatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18387 - RNA, 9867 nt, synthetic construct
  misc_feature 1..9867: note = derived and/or modified CDS sequence (opt4) from DENV-4__JF262783__SS-prME
  source 1..9867: mol_type = other RNA
agcaccgtgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgatgtacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtgaccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgtggtgggcaaggacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcagtggaactacaaggagagaatggtgaccttcaaggtgccccacgccaagagacaggacgtgaccgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgacctgcatcgccatcggcggcatcaccctgttcctgggcttcaccgtgcacgccgacatgggctgcgccgtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcctggaggtggaggactacggcttcggcatgttcgccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacgaggtgctggagagccagatgctgatccccaaggcctacgccggccccttcagccagcacaactacagacagggctacgccacccagaccatcggcccctggcacctgggcaagctggagatcgacttcggcgagtgccccggcaccaccgtgaccatccaggaggactgcaaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctgaccatcatggccgtgttcaagatgagccccggctacgtgctgggcgtgttcctgagaaagctgaccagcagagagaccgccctgatcgtgatcggcatggccatgaccaccgtgctgagcatcccccacgacctgatggagttcatcgacggcatcagcctgggcctgatcctgctgaagatggtggcccacttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcagagtgatcggcctgtacggcaacggcatcgtgaccaagagcggcgactacgtgagcgccatcacccaggccgagagaatcggcgagcccgactacgaggtggacgaggacatcttcagaaagaagagactgaccgtgatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccagaagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagatccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatggccatcgccgtggccagcggcctgctgtgggtggccgagatccagccccagtggatcgccgccagcatcatcctggagttcttcctgatggccctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgagcgtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggccctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtgaacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacagaatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccttcgagagcgagggcgtgctgtga

SEQ ID NO: 18388 - RNA, 9867 nt, synthetic construct
  misc_feature 1..9867: note = derived and/or modified CDS sequence (opt4) from DENV-4__KU513441__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagagagtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18389 - RNA, 9867 nt, synthetic construct
  misc_feature 1..9867: note = derived and/or modified CDS sequence (opt4) from DENV-4__KC762694__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccagcagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18390 - RNA, 9867 nt, synthetic construct
  misc_feature 1..9867: note = derived and/or modified CDS sequence (opt4) from DENV-4__KC762695__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgacagctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcaacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccatccaccaggtgttcggcagcgtgtacaccaccatgttcggcggcgtgagctggatgatcagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcctggaggtggaggactacggcttcggcatgttcagcaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagatcgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtgaccatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacgacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgtggccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatcggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctggaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccatcagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcagccaggtgagaaacctgatcggcaaggaggagtacgtggactacatgcccgtgatgaagagatacagcgcccccagcgagagcgagggcgtgctgtga

SEQ ID NO: 18391 - RNA, 9867 nt, synthetic construct
  misc_feature 1..9867: note = derived and/or modified CDS sequence (opt4) from DENV-4__KC762696__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcatcctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccccgacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18392 - RNA, 9867 nt, synthetic construct
  misc_feature 1..9867: note = derived and/or modified CDS sequence (opt4) from DENV-4__KC762697__SS-prME
  source 1..9867: mol_type = other RNA
agcaccatgaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagtgctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcagcaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagatcgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggccatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacgacacccaggtgggcaccctggccctgagcctgaccttcatcagaagcaccacccccctggtgatggcctggagaaccatcatggccgtgttcttcatggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaaggccgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggccaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagtacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctggaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18393 - RNA, 9867 nt, synthetic construct
  misc_feature 1..9867: note = derived and/or modified CDS sequence (opt4) from DENV-4__KC762698__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgtgtgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgccggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaacaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgagagaggagcacaaggagacctggcactacgaccacgagaacccctacagaacctgggcctaccacggcagctacgaggcccccagcaccggcagcgccagcagcatggtgaacggcatcgtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactggagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggctgctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18394 - RNA, 9867 nt, synthetic construct
  misc_feature 1..9867: note = derived and/or modified CDS sequence (opt4) from DENV-4__KC762699__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgagctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacgtgtggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgtgatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagtacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18395 - RNA, 9867 nt, synthetic construct
  misc_feature 1..9867: note = derived and/or modified CDS sequence (opt4) from DENV-4__JQ915085__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatcatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctgggtggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatccccagagacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggtggtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccatccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccgccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18396 - RNA, 9867 nt, synthetic construct
  misc_feature 1..9867: note = derived and/or modified CDS sequence (opt4) from DENV-4__JQ915088__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcagcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatgagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatggccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcagccccagcgagagcgagggcgtgctgtga

SEQ ID NO: 18397 - RNA, 9867 nt, synthetic construct
  misc_feature 1..9867: note = derived and/or modified CDS sequence (opt4) from DENV-4__JQ915086__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagtgctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18398 - RNA, 9867 nt, synthetic construct
  misc_feature 1..9867: note = derived and/or modified CDS sequence (opt4) from DENV-4__JQ915087__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagcctgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18399 - RNA, 9867 nt, synthetic construct
  misc_feature 1..9867: note = derived and/or modified CDS sequence (opt4) from DENV-4__JQ915089__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagtgctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagcagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgagatcgacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18400 - RNA, 9867 nt, synthetic construct
  misc_feature 1..9867: note = derived and/or modified CDS sequence (opt4) from DENV-4__JQ915082__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacatgagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatcaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggaccccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18401 - RNA, 9867 nt, synthetic construct
  misc_feature 1..9867: note = derived and/or modified CDS sequence (opt4) from DENV-4__JQ915081__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacatgagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatcaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcatcgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggaccccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18402 - RNA, 9867 nt, synthetic construct
  misc_feature 1..9867: note = derived and/or modified CDS sequence (opt4) from DENV-4__JQ915084__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatgagaagcaccacccccctggtgatggcctggagaaccatcatggccgtgttcttcgtgatcaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctggccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagatcggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcagccccagcgagagcgagggcgtgctgtga

SEQ ID NO: 18403 - RNA, 9867 nt, synthetic construct
  misc_feature 1..9867: note = derived and/or modified CDS sequence (opt4) from DENV-4__KM190936__SS-prME
  source 1..9867: mol_type = other RNA
agcaccatcaccctgctgtgcctgatccccaccgtgatggccttcagcctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccatgatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18404 - RNA, 9867 nt, synthetic construct
  misc_feature 1..9867: note = derived and/or modified CDS sequence (opt4) from DENV-4__JQ915090__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctggccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaagatccccatcgagatcagagacgtgaacaaggagaaggtggtgggcagaatcatcagcagcacccccttcgccgagaacaccaacagcgtgatcaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaagatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatgaccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatgagaagcaccacccccctggtgatggcctggagaaccatcatggccgtgttcttcgtgatcaccctgatccccctgtgcagaaccagctgcctgcagaagcagagccactgggtggagatgaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaagcgacatgatcagctacggcggcggctggagactgggcgacaagtgggacaaggaggaggacgtgcaggtgctggccatcgagcccggcaagaaccccagacacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcaccaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacatgagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctgatccactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagatcaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagaatcctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagctgggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccatcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacgtgccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccagcaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcagccccagcgagagcgagggcgtgctgtga

SEQ ID NO: 18405 - RNA, 9867 nt, synthetic construct
  misc_feature 1..9867: note = derived and/or modified CDS sequence (opt4) from DENV-4__KJ160504__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcggcaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagagtgggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccgcctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtggatcgccgagatccagccccagtggatcgccgccagcatcatcctggagttcttcctgatggtgctgctgatccccgagcccgagaagcagagaaccccccaggacaaccagctgatctacgtgatcctgaccgtgctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccgtgctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgttcgtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18406 - RNA, 9867 nt, synthetic construct
  misc_feature 1..9867: note = derived and/or modified CDS sequence (opt4) from DENV-4__GU289913__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccatgatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgagcgtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18407 - RNA, 9867 nt, synthetic construct
  misc_feature 1..9867: note = derived and/or modified CDS sequence (opt4) from DENV-4__KJ579243__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggctgcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcggcctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18408 - RNA, 9867 nt, synthetic construct
  misc_feature 1..9867: note = derived and/or modified CDS sequence (opt4) from DENV-4__KJ579246__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccatccacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18409 - RNA, 9867 nt, synthetic construct
  misc_feature 1..9867: note = derived and/or modified CDS sequence (opt4) from DENV-4__KJ579248__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagagtgggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18410 - RNA, 9867 nt, synthetic construct
  misc_feature 1..9867: note = derived and/or modified CDS sequence (opt4) from DENV-4__KJ579240__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccgtgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18411 - RNA, 9867 nt, synthetic construct
  misc_feature 1..9867: note = derived and/or modified CDS sequence (opt4) from DENV-4__KJ596658__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18412 - RNA, 9867 nt, synthetic construct
  misc_feature 1..9867: note = derived and/or modified CDS sequence (opt4) from DENV-4__KJ596659__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18413 - RNA, 9867 nt, synthetic construct
  misc_feature 1..9867: note = derived and/or modified CDS sequence (opt4) from DENV-4__KJ596661__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatcgagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccaccctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggccagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18414 - RNA, 9867 nt, synthetic construct
  misc_feature 1..9867: note = derived and/or modified CDS sequence (opt4) from DENV-4__KJ596663__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagaccctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18415 - RNA, 9867 nt, synthetic construct
  misc_feature 1..9867: note = derived and/or modified CDS sequence (opt4) from DENV-4__KJ596664__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggaacctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18416 - RNA, 9867 nt, synthetic construct
  misc_feature 1..9867: note = derived and/or modified CDS sequence (opt4) from DENV-4__KJ596665__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcggcctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgagaacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18417 - RNA, 9867 nt, synthetic construct
  misc_feature 1..9867: note = derived and/or modified CDS sequence (opt4) from DENV-4__KJ596668__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtacggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18418 - RNA, 9867 nt, synthetic construct
  misc_feature 1..9867: note = derived and/or modified CDS sequence (opt4) from DENV-4__KJ596670__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcgtgctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccagatcggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18419 - RNA, 9867 nt, synthetic construct
  misc_feature 1..9867: note = derived and/or modified CDS sequence (opt4) from DENV-4__KJ596671__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18420 - RNA, 9867 nt, synthetic construct
  misc_feature 1..9867: note = derived and/or modified CDS sequence (opt4) from DENV-4__KJ579241__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaagatcccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccatgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18421 - RNA, 9867 nt, synthetic construct
  misc_feature 1..9867: note = derived and/or modified CDS sequence (opt4) from DENV-4__KJ596672__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcatcgccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18422 - RNA, 9867 nt, synthetic construct
  misc_feature 1..9867: note = derived and/or modified CDS sequence (opt4) from DENV-4__KJ579242__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatcctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggtgttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccatgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18423 - RNA, 9867 nt, synthetic construct
  misc_feature 1..9867: note = derived and/or modified CDS sequence (opt4) from DENV-4__GQ398256__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagaacggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggccgtgaccgtgcacaacggcgacacccacgccgtgggcaacgacaccagcagccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgagagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgtgggcccctggcacctgggcaagctggagatcgacttcggcgagtgccccggcaccaccgtggccatcagagaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcctgagaagcaccatccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgaagagaggcgacctgcccgtgtggctgagctacaaggtggccagcgccggcatcagctacaaggacagagagtggtgcttcaccggcgagagaaacaaccagatcctggaggagaacatggaggtggagatctggaccaaggagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatcggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccgccatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagatacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccgtgatcggcagaagactgcagagactgcaggaggagcacaaggagacctggcactacgaccaggagaacccctacagaacctgggcctaccacggcagctacgaggcccccagcaccggcagcgccagcagcatggtgaacggcatcgtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtgaacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagcaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaccgagtgcggcgtggacagactgaagagaatggccatcagcggcgacgactgcgtggtgaagcccctggacgagagattcagcgccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18424 - RNA, 9867 nt, synthetic construct
  misc_feature 1..9867: note = derived and/or modified CDS sequence (opt4) from DENV-4__KC333651__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagaacggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgagagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgtgggcccctggcacctgggcaagctggagatcgacttcggcgagtgccccggcaccaccgtggccatcagagaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcctgagaagcaccatccccctggtgatggcctggagaaccatcatggccgtgttcttcgtggtgaccctgatccccctgtgcagaaccagctgcctgcagaagcacagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgctgctggagaaggccgccaacgtgcagtgggacgagatggccgacatcaccggcagcagccccatcatcgaggtgaagcaggacgaggacggcagcttcagcatcagagacgtggaggagaccaacatgatgaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgaagagaggcgacctgcccgtgtggctgagctacaaggtggccagcgccggcatcagctacaaggacagagagtggtgcttcaccggcgagagaaacaaccagatcctggaggagaacatggaggtggagatctggaccaaggagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatcggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccctgtgcgaggtgctgaccctggccaccggccccgccatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagatacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccgtgatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagcaggagggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaccgagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggactacgtggactacatgcccgtgatgaagagatacagcgcccccagcgagagcgagggcgtgctgtga

SEQ ID NO: 18425 - RNA, 9867 nt, synthetic construct
  misc_feature 1..9867: note = derived and/or modified CDS sequence (opt4) from DENV-4__JN559740__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacaccagagccgtgggcaacgacatcagcaaccacggcgtgaccgccatgatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgaagcccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccatcaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgtgcagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18426 - RNA, 9867 nt, synthetic construct
  misc_feature 1..9867: note = derived and/or modified CDS sequence (opt4) from DENV-4__JN559741__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18427 - RNA, 9867 nt, synthetic construct
  misc_feature 1..9867: note = derived and/or modified CDS sequence (opt4) from DENV-4__JQ513334__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccatggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcgagaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtggagctgcccgactacggcgagctgaccctggactgcgagcccagaagcggcatcgacttcaacgagatgatcctgatgaagatgaagaagaagacctggctggtgcacaagcagtggttcctggacctgcccctgccctgggccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcatccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagagtggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18428 - RNA, 9867 nt, synthetic construct
  misc_feature 1..9867: note = derived and/or modified CDS sequence (opt4) from DENV-4__JQ513336__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcgagaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtggagctgcccgactacggcgagctgaccctggactgcgagcccagaagcggcatcgacttcaacgagatgatcctgatgaagatgaagaagaagacctggctggtgcacaagcagtggttcctggacctgcccctgccctgggccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcatccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctggccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18429 - RNA, 9867 nt, synthetic construct
  misc_feature 1..9867: note = derived and/or modified CDS sequence (opt4) from DENV-4__JQ513338__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggagcagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcaacacccccgccgtgggcaacgacaccagcaaccacggcgtgaccgcccccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacgagaaccacatgttcgccggccacctgaagtgcaaggtgagaatgggcaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagatacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtgatcgacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18430 - RNA, 9867 nt, synthetic construct
  misc_feature 1..9867: note = derived and/or modified CDS sequence (opt4) from DENV-4__JQ513339__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggccaccttcaaggtgccccacgccaagagacaggacgtgaccctgctgggcagccaggagggcgccatgcacagcgccctggccggcgccaccgaggtggacagcggcgacgagaaccacatgttcgccggccacctgaagtgcaaggtgagaatgggcaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgctgagcgccacccccctggccgagaacaccaacagcgtgaccaacatcgagctggagccccccttcggcgacagctacatcgtgatcggcgtgggcaacagcgccctgaccctgcactggttcaccaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtgatcgacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18431 - RNA, 9867 nt, synthetic construct
  misc_feature 1..9867: note = derived and/or modified CDS sequence (opt4) from DENV-4__JQ513343__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggagaccttcaaggtgccccacgccaagagacaggacgtgaccctgctgggcagccaggagggcgccatgcacagcgccctggccggcgccaccgaggtggacagcggcgacgagaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtgatcgacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18432 - RNA, 9867 nt, synthetic construct
  misc_feature 1..9867: note = derived and/or modified CDS sequence (opt4) from DENV-4__KT276273__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcagacccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtggagctgcccgactacggcgagctgaccctggactgcgagcccagaagcggcatcgacttcaacgagatgatcctgatgaagatgaacaagaagacctggctggtgcacaagcagtggttcctggacctgcccctgccctggaccgccggcgccgacaccagcgaggtgcactggaacaacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtgatcggcagagtgatcagcagcatccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgagatgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagatcgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccctacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccaaggaggagttcatcagcaaggtgagagccaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcgccaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgaaggagaccgcctgcctggccaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacatggactacatgcccgtgatgagaagatacagcgcccccagcgagagcgagggcgtgctgtga

SEQ ID NO: 18433 - RNA, 9867 nt, synthetic construct
  misc_feature 1..9867: note = derived and/or modified CDS sequence (opt4) from DENV-4__KU523872__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcccacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggaacggcaaggagctgaagtgcggcaacggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctgggtggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcatcagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccgtgatcgaggtgaagcaggacgaggacggcagcttcagcatcagagacgtggaggagaccaacatgatcaccctgctggtgaagctggccctgatcaccgtgagcggcctgtaccccctggccatccccgtgaccatggccatctggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggaagctgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcagcatcgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccaccctgcccacctacctgagcagcaaggccaagctggccctggacaacatcgtgatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctggtggccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatcggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccctgtgcgaggtgctgaccctggccaccggccccatcatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgagagacggcagcaagaccaagcacgccgtgagcagaggcagcagcaagatcagatggatcgtggagagaggcatgatcaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcaagaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagatacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagaaagatcatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcagatgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccgagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgaagagatacagcgcccccttcgagagcgagggcgtgctgtga

SEQ ID NO: 18434 - RNA, 9867 nt, synthetic construct
  misc_feature 1..9867: note = derived and/or modified CDS sequence (opt4) from DENV-4__KP140942__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcagacccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtggagctgcccgactacggcgagctgaccctggactgcgagcccagaagcggcatcgacttcaacgagatgatcctgatgaagatgaacaagaagacctggctggtgcacaagcagtggttcctggacctgcccctgccctggaccgccggcgccgacaccagcgaggtgcactggaacaacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtgatcggcagagtgatcagcagcatccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgagatgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagatcgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtggccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatgggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcctgaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccaaggaggagttcatcagcaaggtgagagccaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcgccaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgaaggagaccgcctgcctggccaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacatggactacatgcccgtgatgagaagatacagcgcccccagcgagagcgagggcgtgctgtga

SEQ ID NO: 18435 - RNA, 9867 nt, synthetic construct
  misc_feature 1..9867: note = derived and/or modified CDS sequence (opt4) from DENV-4__KU523871__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagaacggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaatcgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgagagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccagaggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccagaagctacgccggccccttcagccagcacaactacagacagggctacgccacccagaccgtgggcccctggcacctgggcaagctggagatcgacttcggcgagtgccccggcaccaccgtggccatcagagaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggccaccgccggccagggcaccagcgagaccttcagcatgggcctgctgtgcctgaccctgttcgtggaggagtgcctgagaagaagagtgaccagaaagcacatgatcctggtggtggtgatcaccttctgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgttcagcatcccccacgacctgatggagctgatcgacggcatcagcctgggcctgatcctgctgaagatcgtgacccacttcgacaacacccaggtgggcaccctggccctgagcctgaccttcctgagaagcaccacccccctggtgatggcctggagaaccatcatggccgtgttcttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatgaccctgctggtgaagctggccctgatcaccgtgagcggcctgtaccccctggccatccccgtgaccatggccctgtggtacatctggcaggtgaagacccagagaagcggcgccctgtgggacgtgcccagccccgccgccacccagaaggccaccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgacccctgcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagagagtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgaagagaggcgacctgcccgtgtggctgagctacaaggtggccagcgccggcatcagctacaaggacagagagtggtgcttcaccggcgagagaaacaaccagatcctggaggagaacatggaggtggagatctggaccaaggagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcaaggccaagctggccctggacaacatcatcatgctgcacaccaccgagaagggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatcggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccctgtgcgaggtgctgaccctggccaccggccccgccatgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgccagcggcaacatcgtgagcagcgtgaacaccatcagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagaatgatcatgaccaccaccgccaactggctgtggaccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatgtggtacatgtggctgggcgccagattcctggagttcgaggccctgggcttcctgaacgaggaccactggttcagcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagaccctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaccgagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgtacagctgggaggacatcccctacctgggcaagagagaggacctgtggtgcggcagcctgatcggcctgagcagcagagccacctgggccaagaacatccacaccgccatcacccaggtgagaaacctgatcggcaaggaggactacgtggactacatgcccatcatgaagagatacagcgcccccagcgagagcgagggcgtgctgtga

SEQ ID NO: 18436 - RNA, 9867 nt, synthetic construct
  misc_feature 1..9867: note = derived and/or modified CDS sequence (opt4) from DENV-4__HQ332175__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgtggacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcgcccaggtgagaaacctgatcggcaaggaggagtacgtggactacatgcccgtgatgaagagatacagcgcccccagcgagagcgagggcgtgctgtga

SEQ ID NO: 18437 - RNA, 9867 nt, synthetic construct
  misc_feature 1..9867: note = derived and/or modified CDS sequence (opt4) from DENV-4__HQ332172__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccaccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccatcctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggccctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18438 - RNA, 9867 nt, synthetic construct
  misc_feature 1..9867: note = derived and/or modified CDS sequence (opt4) from DENV-4__HQ332176__SS-prME
  source 1..9867: mol_type = other RNA
agcaccatcaccctgctgtgcctgatccccaccgtgatggccttccacctgagcaccagagacggcgagcccctgatgatcgtggccagacacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccagctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18439 - RNA, 9867 nt, synthetic construct
  misc_feature 1..9867: note = derived and/or modified CDS sequence (opt4) from DENV-4__HQ332174__SS-prME
  source 1..9867: mol_type = other RNA
agcaccatcaccctgctgtgcctgatccccaccgccatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccatgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcgccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggccaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaaccgtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18440 - RNA, 9867 nt, synthetic construct
  misc_feature 1..9867: note = derived and/or modified CDS sequence (opt4) from DENV-4__KT026308__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgcagctgcccgactacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccgtgcaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccacggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccgtgttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtgatcaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagccacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatgggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccatgggcgagaccctgggcgagaagtggaagagacagctgaacagcctggacagaaaggagttcgaggagtacaagagaagcggcatcctggaggtggacagaaccgaggccagaagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcacccaggtggtgatgaccaccaccgccaactggctgtggaccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatgaccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgagaagatacagcgcccacttcgagagcgagggcgtgctgtga

SEQ ID NO: 18441 - RNA, 9867 nt, synthetic construct
  misc_feature 1..9867: note = derived and/or modified CDS sequence (opt4) from DENV-4__KT026309__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgcagctgcccgactacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccgtgcaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccacggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccgtgttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtgatcaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagccacaaggtggccagcgccggcatcagctacaaggacagagagtggtgcttcaccggcgagagaaacaaccagatcctggaggagaacatcgaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatgggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgtgggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccatgggcgagaccctgggcgagaagtggaagagacagctgaacagcctggacagaaaggagttcgaggagtacaagagaagcggcatcctggaggtggacagaaccgaggccagaagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcacccaggtggtgatgaccaccaccgccaactggctgtggaccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatgaccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgagaagatacagcgcccacttcgagagcgagggcgtgctgtga

SEQ ID NO: 18442 - RNA, 9867 nt, synthetic construct
  misc_feature 1..9867: note = derived and/or modified CDS sequence (opt4) from DENV-4__KF907503__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccatgatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccagcaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctgatcatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccagcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcatcatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgagcgtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18443 - RNA, 9867 nt, synthetic construct
  misc_feature 1..9867: note = derived and/or modified CDS sequence (opt4) from DENV-4__AY947539__SS-prME
  source 1..9867: mol_type = other RNA
agcaccatgaccctgctgtgcctgatccccaccgccatggccttccacctgagcaccagagacggcgagcccctgatgatcgtggccagacacgagagaggcagacccctgctgttcaagaccaccgagggcatcaacaagtgcaccctgatcgccatggacctgggcgagatgtgcgaggacaccgtgacctacgagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacatccccaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctgggccgccggcgccgacaccagcgaggtgcactggaactacaaggagagaatggtgaccttcaaggtgccccacgccaagagacaggacgtgaccgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagtacaccaacagcgtgaccaacatcgagctggagccccccttcggcgacagctacatcgtgatcggcgtgggcgacagcgccctgaccctgcactggttcagaaagggcagcagcatcggcaagatgctggagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcacgccgacaccggctgcgccgtgagctggagcggcaaggagctgaagtgcggcagcggcatcttcgtgatcgacaacgtgcacacctggaccgagcagtacaagttccagcccgagagccccgccagactggccagcgccatcctgaacgcccacgaggacggcgtgtgcggcatcagaagcaccaccagactggagaacatcatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgaggccaagaacagcaccttcctgatcgacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacatcgaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaaccggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcagcaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagaaccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgatcgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccgtgctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccttcgagagcgagggcgtgctgtga

SEQ ID NO: 18444 - RNA, 9879 nt, synthetic construct
  misc_feature 1..9879: note = derived and/or modified CDS sequence (opt5) from DENV-1__AB608789__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatattgactgttggtgcaatgccacggatacctgggtgacatatggaacctgtagccaaacaggcgagcacagacgggacaagcgctccgtggccctggctcctcatgtcgggctgggactcgagaccagaacggaaacatggatgtctagcgagggcgcctggaaacagatccagcgggtggaaacctgggctctgcgccaccccggcttcacagttattgccctttttctggcgcatgccatcgggacctccatcacccagaagggaattatcttcattctcctgatgcttgtgacaccttctatggctatgagatgcgtcggcatcgggagccgggattttgtggagggactgtccggcgccacgtgggttgacgtggtcctcgagcacgggagctgtgtgaccacaatggctaaggataaacccaccctggacattgaactgctcaagacagaggtgaccaaccctgccgtcctgcgcaaactttgcatcgaagcgaagatttctaatacgacaaccgattccagatgtccgacccaaggagaggccacactggttgaagagcaggacgctaacttcgtgtgccggcgcacctttgtggatagaggctggggcaatgggtgtggactcttcggcaaagggagcctgatcacatgcgccaagtttaagtgcgtcacgaaacttgagggaaagatcgtgcagtacgaaaacctgaaatattctgttattgtgaccgtccacacaggcgaccagcatcaagtggggaatgagtccaccgaacacggaacaaccgctacgatcaccccccaggcccctacaagcgagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagcccccctttggcgagagctatatcgtgattggggccggagaaaaagctcttaagctctcttggttcaagagaggcagctccatcgggaaaatgtttgaggccacagctcgcggcgcccggagaatggcgatcctgggagataccgcctgggacttcggctctattgggggagtgtttacaagcgttggcaagctggtccatcagatcttcgggaccgcttacggagtgctcttttccggcgtgagctggacgatgaaaattgggatcggcgtcctgcttacctggctgggactcaattctcgctccacaagcctgtctatgacctgtattgccgtgggcctggttacactttacctcggggtgatggtccaggctgattccggatgcgtgatcaactggaagggccgggaactgaaatgtgggagcggaattttcgttaccaatgaggtgcacacatggaccgaacaatataagtttcaggccgactcccctaagagactgtctgcggccatcggcaaagcttgggaggagggggtctgcggcatccgcagcgccacgcggctcgaaaacattatgtggaagcagatctccaacgagctgaatcatattcttctggaaaacgacatgaaattcacagtggttgtgggagatgtcgtgggcatcctcgctcaggggaagaaaatgattagaccgcaacccatggagtacaagtattcttggaaaagctggggaaaggccaagatcatcggcgccgacgtgcagaataccacctttattatcgatgggcctaacacacccgaatgtcctgacgatcagcgcgcttggaatatttgggaggtcgaggactacggattcggcatctttaccacgaacatttggctgaaactgcgggattcctatacacaggtttgcgaccacagacttatgagcgcggccatcaaggattctaaagctgtgcacgccgacatgggctactggatcgaatccgagaagaatgaaacctggaaactcgcccgcgctagcttcattgaggtgaagacatgtatctggcccaagtctcataccctgtggtccaacggggtcctggaaagcgagatgattatcccgaaaatttatggaggccctatctctcaacacaattaccggcccgggtacttcacacagaccgccggaccttggcatctcggcaagctggagcttgattttgacctgtgcgaagggacgaccgtggttgtggatgagcactgcggaaacagaggccccagcctccggacaaccacagtcaccggcaaaatcattcacgaatggtgttgccgctcctgtacgctgcctcccctgagattcaagggggaggacggatgctggtatggcatggagatccggccggtgaaagaaaaggaggaaaatcttgttaagagcatggtgtctgcggggtccggagaggtcgacagcttttccctcggcctgctgtgtatgtctattatgatcgaagaggtgatgagaagccgctggtcccggaaaatgctcatgacagggaccctggctgttttccttctgctcattatgggacagctgacatggaacgatctgatcagactttgcattatggtgggcgccaatgcctctgaccgcatgggcatggggaccacctacctggctctcatggccacatttaagatgagacctatgttcgcggtcggactgctctttcggcgcctgacgagcagagaggtgcttctgctcaccatcggcctgtccctggtggcttctgtcgaacttcccaacagcctggaggaactcggggatggactggccatgggcatcatgattctcaaactgcttacagacttccaatcccatcagctgtgggccaccctcctgagcctgacatttatcaagaccacggtttctcttcactatgcttggaaaacaatggccatggtgctgtccattgtgagcctcttccccctgtgtctctctaccacctcccagaagacaacctggctgcctgtccttctggggagcctgggatgcaagccgctcacaatgtttctgatcgctgagaataaaatttggggccggaagtcttggccccttaacgaaggcatcatggccgtggggatcgtttccattctgctcagctccctgctcaaaaacgatgtgcctctggcgggaccccttatcgccggcgggatgctgattgcttgttacgtcatcagcggatctagcgccgacctgtccctcgagaaggctgccgaggtgtcttgggaagaggaagccgagcatagcggcgcttcccacaatattctggttgaagtgcaggatgacgggacgatgaaaatcaaggatgaggagcgcgacgatacccttacaatcctgctcaaagcgaccctgctcgccgtctctggagtgtatcctctgagcattcccgctacacttttcgtctggtacttttggcaaaagaagaaacagagatccggcgtgctgtgggacaccccttctcccccggaagttgagcgggccgtgctggatgaaggcatctatcgcattatgcagagagggctcctgggacggagccaggtcggcgtgggggttttccaagagaacgtgttccatacgatgtggcacgtcacccgcggagccgtgcttatgtaccagggcaagagactggagccttcctgggctagcgtgaaaaaggacctcatctcttacgggggaggctggcggctgcagggctcctggaatacaggggaagaggttcaggtcattgccgtggaacccggaaaaaaccctaagaatgtgcaaaccgcgcccggcacatttaagaccccggagggggaagtcggagctatcgccctcgacttcaaacctggcacaagcgggtctcccattgtgaacagagagggaaagatcgttggcctgtatggcaatggggtggtcacgacctccggaacatacgtgagcgccatcgctcaggccaaagcgtcccaggagggccctcttcccgaaattgaggatgaagtttttcgcaagcggaacctgaccatcatggacctgcaccccgggtctggaaaaaccagacgctatctccctgctattgtgcgggaggccatcaagagaaagctgcgcacacttattctggccccgacgcgggtcgtggctagcgaaatggccgaggctctcaaaggcatgcccatcagataccaaaccacagccgttaagtccgagcataccgggaaagaaatcgtggatctgatgtgccacgcgacattcaccatgcgcctgctcagccctgtccgggtgcccaattataacatgattatcatggacgaggcccattttacggatccttcttccattgctgccagaggctacatcagcacacgggtgggaatgggcgaagctgccgccattttcatgaccgctaccccccctgggtctgtcgaggcgtttccgcagagcaatgccgttatccaggacgaagagcgcgatatccccgagagatcctggaactctggatatgaatggattacagacttccctggcaagaccgtgtggtttgtgcccagcatcaaatccgggaatgatattgctaactgtcttcggaagaatggaaagcgcgtcatccagctgtctagaaaaacattcgacaccgagtaccaaaagacgaaaaacaacgattgggactacgtggttacaaccgacattagcgaaatgggcgccaattttcgggccgatagagtgatcgaccctcgccggtgcctgaagcccgtcattctcaaagatgggccggagagagtgatcctggctggccctatgcccgttacagtggcctccgcggctcagcgccggggaagaatcggccgcaaccacaataaggagggggaccagtatatttacatgggacagccccttaacaatgatgaagaccatgcccactggaccgaggccaagatgctgctcgataacatcaatacgcctgaaggcattatccccgctctgttcgagcctgaacgggagaaaagcgccgcgattgacggggagtatagactgcgcggagaagccagaaagaccttcgtcgagctcatgcggcgcggcgatcttccggtgtggctgtcttacaaagtcgcttccgaagggtttcaatatagcgacagacggtggtgcttcgatggcgagcgcaacaatcaggtgctggaagagaacatggacgttgagatctggacaaaggaaggagagagaaaaaagctccggcccagatggctggatgcccgcacctactccgaccctcttgctctgcgggaatttaaagagttcgccgctggcagacgctctgtgagcggggacctcatcctggaaattggaaagctgccccagcacctcacacagcgggcccaaaatgcgcttgataacctggtgatgctgcataattccgagcagggcgggagagcctatcggcacgctatggaggaactccctgacaccatcgagacactgatgcttctggccctcattgctgtcctgaccggaggcgttacgctgtttttcctctctggccgcgggcttggaaagacaagcatcggcctgctgtgtgtgatggcctccagcgtgctcctgtggatggcctctgtcgaaccccattggattgctgcgtccatcatccttgagtttttcctgatggtgctcctgattccggagcctgatagacagcggaccccccaggacaaccaactggcctacgttgtgatcgggctcctttttatgattctgaccgtcgctgccaatgaaatgggactgctcgagacaaccaaaaaggatctgggcatcgggcacgtggccgtcgaaaaccaccatcacgctacaatgcttgacgtggatctgcatcctgccagcgcgtggacgctctacgccgttgctaccacaattatcacccccatgatgcgccacacaattgagaacaccacggccaatatctctctgaccgctatcgccaaccaggcggccattctgatgggactcgacaaaggctggcctatctccaagatggatattggcgtgccccttctggctctggggtgctatagccaggtcaatccgctcacactgaccgccgctgtgcttatgctggttgcccattacgctatcattggacctggcctccaagccaaagcgacaagagaagcccagaagcggaccgctgccgggatcatgaagaaccccacggtggacggaatcgtcgctattgatctggaccccgtggtgtatgatgccaaattcgagaagcagctgggccagatcatgctccttattctgtgtacatctcaaatcctgctcatgcgcaccacatgggccctgtgcgagagcattacccttgcgaccgggcctctgacaacgctctgggaaggatccccgggcaaattttggaataccacaatcgctgtttctatggccaacatcttcagaggcagctacctggctggggccggactggccttttccctcatgaagagccttggcgggggacggcgcggcaccggggctcagggagagacactgggcgaaaaatggaagagacagctgaatcagctctccaagtctgagttcaacacctataaacggagcggcattatggaagtcgacagatccgaggccaaggagggggtgaaacgcggagaaacgacaaagcacgcggtgtctcggggcaccgccaaactgagatggttcgtcgagcgcaatcttgttaagcccgaagggaaggtgatcgacctgggatgtggccgggggggatggagctactattgcgctggcctcaaaaaggtgaccgaggtcaaaggctacacaaaggggggacctggccacgaagagcccattcctatggccacctacgggtggaacctggtgaaactgcattccggaaaggatgtttttttcacaccccctgagaaatgtgacacgctcctttgcgatatcggcgaatctagcccgaatcccaccattgaggaagggagaacactgcgcgtgctgaagatggtcgagccttggctccggggaaaccaattttgtatcaagattctgaatccctatatgccttccgtggttgagacccttgaacagatgcagagaaaacacggcggcatgctggtgcgcaaccccctcagccggaattctacacatgagatgtactgggtctcctgcgggaccggaaacatcgtgagcgctgtgaatatgacgtctagaatgctgctgaaccgcttcaccatggcccaccggaagccgacatatgaaagagacgtcgatctcggcgcggggacccgccacgttgccgtggagcctgaagtggctaacctggacatcattggacagagaatcgagaatattaaacatgagcacaagtccacatggcattacgatgaagacaacccctataaaacctgggcctaccacggcagctatgaggtcaagccctctgggtccgctagctccatggtgaatggagttgtgaagcttctgacaaaaccttgggatgtcatccccatggtgacccaaattgccatgacggacacaaccccttttggccagcagcgggttttcaaggaaaaagtggatacccgcacaccgaaggctaaaagaggcacggcccaaatcatggaggtcaccgcgcggtggctctgggggtttctgagcagaaacaagaagccccggatctgtacacgcgaagagttcaccagaaaagtgcggtctaatgccgctattggagccgtttttgtggacgagaaccagtggaatagcgctaaggaagccgtcgaggacgaacgcttctgggatcttgtgcatagagagcgggaactgcacaaacagggcaagtgcgccacatgcgtctacaacatgatggggaaacgcgagaagaagctcggagagtttggcaaagcgcctgaatccagagctatctggtacatgtggctgggggcccggttcctggagtttgaagccctcggcttcatgaatgaggaccactggttctctcgcgagaacagcctgtccggagtggaaggcgaggggcttcataagctgggatatattctcagagatatctctaaaattcccggcgggaatatgtacgctgacgataccgccggatgggacacacggatcaccgaagatgacctgcagaacgaggctaagatcacggatattatggaacctgagcacgcccttctggcgaccagcatctttaaactcacatatcaaaataaggttgtgcgcgtccagagacccgccaaaaacggcaccgtgatggacgtgatttcccggcgcgatcagagagggtctggccaggttggaacatacggcctgaataccttcacgaacatggaggctcaactgatccggcagatggaaagcgaggggattttttccagctctgaactcgagacaccgaacctggccgaaagagtgcttgactggctgggaaagtatggcgtcgagcgcctcaagcggatggctatctccggggatgactgtgtggttaaacctatcgacgatagattcgccaccgcgctgacagcccttaatgacgtgggaaaggtccgcaaagatattccccagtgggagcctagcaagggctggaacgactggcagcaagtgcccttttgctctcatcacttccaccagctgatcatgaaagatgggcgggaaattgtcgtgccttgtagaaatcaggacgagctcgttggccgcgctcgggtgtcccagggagccggctggagcctgagagaaaccgcttgcctggggaagtcctacgcccaaatgtggcagctcatgtattttcatcgccgggatctgagacttgctgccaacgcgatctgttctgccgtccccgtggactgggttccgacgagccgcaccacatggtccattcacgctcatcaccagtggatgaccacagaggatatgctgagcgtgtggaatcgggtctggatcgaagagaacccttggatggaggacaagacccatgtgtcttcctggggagatgtgccctacctcggcaaaagagaagaccaatggtgcgggagcctgattggacttacagcccgggccacctgggctacgaatatccaggttgccatcaaccaggtcagacgcctgattggcaatgagaactacctcgactatatgacatctatgaagcggttcaaaaatgaaagcgatcccgagggggcgctgtggtga

SEQ ID NO: 18445 - RNA, 9879 nt, synthetic construct
  misc_feature 1..9879: note = derived and/or modified CDS sequence (opt5) from DENV-1__AB608788__SS-prME
  source 1..9879: mol_type = other RNA
agcgtgaccatgctgctcatgctgcttcccacagtcctggccttccacctcacgaccagaggcggggagcctcatatgatcgttacaaagcaggaacggggaaaatccctgctttttaagacctctgctggcgtgaacatgtgcacactgattgccatggacctcggggagctgtgtgaagataccatgacatacaaatgcccgcgcatcaccgaggcggaacccgacgatgtggactgttggtgcaatgctacggatacctgggtcacatatggaacctgtagccaaacaggcgagcacagacgggacaagcgctccgtggccctggcccctcatgttgggctcggactggagaccagaacggaaacatggatgtctagcgagggcgcttggaaacagattcagcgggtggaaacctgggcccttcgccaccccggcttcacagtcatcgctctgtttctcgcccatgcgattgggacctccatcacccagaagggaatcattttcatcctgcttatgctggtgacaccttctatggccatgagatgcgttggcattgggaaccgggattttgtggagggactcagcggcgctacgtgggtcgacgtggtgctggagcacgggtcctgtgtcaccacaatggccaaggataaacccaccctggacatcgaactcctgaagacagaggttaccaatcctgctgtgcttcgcaaactgtgcattgaagccaagatcagcaacacgacaaccgattctagatgtccgacccaaggagaggcgacactcgtggaagagcaggacgccaatttcgtctgccggcgcacctttgtggatagaggctggggcaacgggtgtggactgttcggcaaagggtcccttattacatgcgctaagtttaagtgcgttacgaaactggagggaaagatcgtgcagtacgaaaatctcaaatatagcgtcatcgtgaccgttcacacaggcgaccagcatcaagtggggaacgagtctaccgaacacggaacaaccgccacgattaccccccaggctcctacatccgagatccagctgaccgactacggcgccctgacactcgattgtagcccccggaccggcctggacttcaatgaaatggtccttctgacgatgaaggagaaatcttggctcgtgcataagcagtggtttctggatcttcctctgccctggacatccggggccaccacaagccaagagacctggaaccgccaggacctcctggtcaccttcaaaacagctcacgcgaagaagcaggaagtggttgtgctgggatcccaagagggcgccatgcacacggctctcaccggggccacagaaattcagacctctggaacaaccacgatctttgccggccatctgaaatgcagacttaagatggataaactgacactcaaggggatgagctatgtcatgtgtaccggctccttcaaactggagaaggaagtggctgagacccagcacggaacagttctggtgcaggtcaagtacgagggcaccgacgccccgtgcaaaattcctttcagcacacaagatgaaaagggggtgacgcagaatggacgggtgatcaccgcgaaccccatcgttacagacaaagagaagcctgtcaatattgaagctgagcccccctttggcgagtcttatatcgtggtgggggccggagaaaaagcccttaagctctcctggttcaagaaaggcagcaccattgggaagatgtttgaggctacagccagaggcgctcgccggatggccatcctgggagataccgcgtgggacttcggctctattgggggagtctttacgagcgtgggcaaactggttcatcagatcttcgggaccgcctacggagtgctcttttccggcgtctcttggacaatgaagatcgggattggcgtgctgcttacctggctgggactcaacagcagatccacaagcctgtctatgacctgtatcgctgttggcctggtgacactttacctcggggtcatggtgcaggccgattccggatatgttattaattggaaaggccgcgaactgaagtgcgggagcggaatcttcgtgaccaacgaggtccacacgtggacagaacaatacaagtttcaggctgactctcctaaacggctgtccgccgcgattggcaaggcctgggaggagggggtgtgtggcatcagaagcgctacccgcctcgaaaacattatgtggaaacagatctccaatgagctgaaccatatccttctggaaaatgacatgaagttcaccgtggtcgttggagatgtgtctggcattctcgcccaggggaaaaagatgatccggccgcaacccatggagcacaaatatagctggaagtcctggggaaaggctaaaattatcggcgccgacgtgcagaactctacatttattatcgatgggcctaatacccccgaatgccctgacgatcagagagcctggaacatctgggaggtcgaggactacggattcggcatttttacgacaaatatctggctgaagctgcgcgatagctatacccaggtgtgtgaccaccggcttatgtccgctgcgattaaagatagcaaggccgttcatgctgacatgggctactggatcgaatctgagaaaaacgaaacatggaagctcgccagagcctccttcattgaggtgaagacctgcgtctggcccaaaagccacacactgtggtctaatggggtgctggaatccgagatgatcatcccgaagatttatggaggccctatcagccaacataactaccgccccgggtacttcacccagacgtctggaccttggcacctcggcaaactggagcttgattttgacctgtgtgaagggaccacagttgtggtcgatgagcactgcggaaatcggggccccagcctcagaaccacaaccgtgacgggcaagattatccatgaatggtgctgtcggtcctgcacactgcctcccctgcgcttcaaaggggaggacggatgttggtatggcatggagattagaccggttaaggaaaaggaggaaaaccttgtgaaaagcatggtctctgctgggtccggagaggtggacagcttttccctcggcctgctgtgcatctctatcatgattgaagaggtgatgcggagcagatggtcccgcaagatgctcatgaccgggacactggccgtcttccttctgctcatcatgggacagctgacctggaatgatctgattcggctttgtatcatggttggcgcgaacgcttctgacagaatgggcatggggaccacatacctggccctcatggccacgtttaaaatgcgccctatgttcgctgtgggactgctctttagacggctgaccagccgcgaggtgcttctgctcacaattggcctgtccctggtcgcctctgtggaacttcccaatagcctggaggaactcggggatggactggcgatgggcatcatgattctcaagctgcttaccgacttccaatcccaccagctgtgggctgccctcctgagcctgacatttatcaaaaccacgttctctcttcattatgcctggaagacaatggctatggttctgtccatcgtgagcctctttcccctgtgcctctctaccacctcccagaagacaacctggctgcctgtccttctggggagcctgggatgtaaaccgctcacaatgttcctgattgccgagaacaagatctggggcagaaaatcttggccccttaacgaaggcattatggctgtggggatcgtttccattctgctcagctccctgctcaagaatgatgtgcctctggccggaccccttatcgcgggcgggatgctgatcgcctgctacgtcattagcggatctagcgctgacctgtccctcgagaaagccgctgaggtgtcttgggaagaggaagccgagcacagcggcgcctcccataacatcctggtcgaagtgcaggatgacgggacgatgaagattaaagatgaggagcgggacgatacccttacaatcctgctcaaggctaccctgctcgcggtttctggagtgtatcctctgagcattcccgccacactttttgtctggtacttctggcaaaagaaaaagcagcgctccggcgtgctgtgggacaccccttctcccccggaagttgagagagctgtgctggatgacggcatctatcggatcatgcagcgcgggctcctgggaagaagccaggtcggcgtgggggtgttccaagaaaatgtttttcacacgatgtggcacgtcacccggggagccgtgcttatgtaccagggcaaacgcctggagccttcctgggccagcgtgaagaaagacctcatttcttacgggggaggctggagactgcagggctcctggaacacaggggaggaagtccaggtgatcgctgttgagcccggaaagaatcctaagaacgtgcaaaccgcccccggcacattcaaaaccccggaaggggaggtcggagcgattgctctcgattttaagcctggcacaagcgggtctcccatcgtgaatcgggaaggaaaaattgttggcctgtatggcaacggggtggtcacgacctccggaacatacgtgagcgccatcgcccaggctaaggcctcccaggagggccctcttcccgagattgaagacgaggttttcagaaaacgcaatctgaccatcatggatctgcatcccgggtctggaaagacccggagatatctccctgcgatcgtgcgcgaagctattaagcggaaactgagaacacttatcctggccccgacgcgcgtcgtggccagcgagatggctgaagccctcaagggcatgcccattcggtaccaaaccacagctgtgaaatccgagcacaccgggaaggagatcgtcgacctgatgtgtcatgccacatttaccatgagactgctcagccctgttcgcgtgcccaactataatatgattatcatggatgaagcgcacttcacggacccttcttccatcgccgctcggggctacattagcacaagagtgggaatgggcgaggccgctgccatctttatgaccgccaccccccctgggtctgtcgaagctttcccgcagagcaacgcggtgattcaggatgaggaacgggacatccccgagcgctcctggaattctggatatgattggattacagactttcctggcaaaaccgtttggttcgtgcccagcatcaagtccgggaacgatatcgccaattgccttagaaagaacggaaaacgggtcattcagctgtctcgcaagacatttgacaccgagtaccaaaaaacgaagaacaatgactgggattacgtggttacaaccgacatcagcgaaatgggcgctaacttcagagccgatcgggtgattgaccctagacgctgtctgaaacccgtcatcctcaaggatgggccggagcgggtgattctggccggccctatgcccgtcacagtggcttccgccgcgcagagacgcggacggatcggcagaaatcagaacaaggaaggggaccagtatatttacatgggacaaccccttaataacgatgaggaccatgctcactggaccgaggccaaaatgctgctcgataatatcaacacgcctgaaggcatcattcccgccctgttcgagcctgaacgcgagaagagcgctgccatcgacggggaatatcggctgagaggagaggcgcgcaaaacctttgttgagctcatgagacggggcgatcttccggtgtggctgtcttacaaggtggcctccgaagggttccagtatagcgaccgcagatggtgctttgatggcgagcggaataaccaggtcctggaagagaatatggacgttgaaatttggacaaaagagggagagcgcaagaaactcagaccccggtggctggacgctagaacctactccgatcctcttgccctgcgcgaattcaaggagtttgctgccggccggagatctgtgagcggggacctcatcctggaaattggaaagctgccccagcacctcacacaacgcgctcagaacgcccttgataatctggtgatgctgcataactccgagcagggcgggcgggcgtatagacacgccatggaagagctccctgacaccatcgagacactgatgcttctggctctcatcgccgtcctgaccggaggcgtgacgctgttctttctctctggccgggggcttggaaaaacaagcattggcctgctgtgcgttatggcttccagcgtgctcctgtggatggcctctgtcgaaccccattggatcgccgcttccattatccttgagttctttctgatggtgctcctgattccggaacctgatcgccagagaaccccccaagacaatcagctggcgtacgtcgtgatcgggctccttttcatgatcctgaccgttgccgctaacgagatgggactgctcgagacaaccaagaaagatctgggcattgggcacgtggccgtcgaaaaccaccatcacgccacaatgcttgacgtggatctgcatcctgctagcgcctggacgctctacgcggttgccaccacaatcattacccccatgatgcggcacacaatcgagaataccacggctaacatttctctgaccgccatcgctaatcaggccgcgattctgatgggactcgacaagggctggcctatctccaaaatggatatcggcgtgccccttctggccctggggtgttatagccaagtcaacccgctcacactgaccgctgccgtgcttatgctggtggctcattacgccattatcggacctggcctccaggctaaggccacacgcgaagcgcagaagagaaccgccgctgggattatgaaaaatcccacggttgacggaatcgtcgccattgatctggaccccgtggtgtatgacgctaagtttgagaaacagctgggccaaatcatgctccttatcctgtgcacatctcagattctgctcatgcggaccacatgggccctgtgtgaaagcatcacccttgccaccgggcctctgacaacgctctgggagggatccccgggcaagttctggaacaccacaattgcggtctctatggctaatatctttcgcggcagctacctggccggggctggactggccttctccctcatgaaaagccttggcgggggaagacggggcaccggggcccagggagagacactgggcgaaaagtggaagcgccagctgaaccaactctccaaatctgagttcaatacctataagagaagcggcattatcgaagttgatcggtccgaggctaaagaagggctgaagagaggagagacgacaaaacacgccgtgtctcgcggcaccgcgaagcttcggtggtttgtggagagaaacctggtcaagcccgaagggaaagtgatcgacctcggatgcggccgcgggggatggagctactattgtgccggcctgaagaaagttaccgaggtgaagggctacacaaaagggggagctggccacgaagagcctattcccatggccacctacgggtggaatctggtcaagctctattccggaaaagatgtgttctttacacctcccgaaaagtgcgacacgcttctgtgtgatatcggcgagtctagccctaacccgaccattgaggaagggcggacactgagagttctcaagatggtggagccctggctgcgcggaaatcagttctgcatcaaaattcttaacccttacatgccctccgtcgtggaaaccctggagcagatgcagcggaagcatggcggcatgctcgtgagaaatcctctgagccgcaactctacacacgagatgtattgggtctcctgtgggaccggaaatatcgttagcgctgtgaacatgacgtctcggatgctgctcaacagatttaccatggcccatcgcaaacccacatacgaacgggacgtggatctgggcgcggggaccagacacgtcgccgtggagccggaagttgctaatcttgacattatcggacaacgcatcgagaacattaagcacgaacataaatccacatggcactatgatgaggacaatccttacaagacctgggcctatcatggcagctacgaggtgaagccctctgggtccgctagctccatggtcaacggagtggttagactgctcacaaaaccctgggatgtgatccctatggtcacccagattgccatgacggacacaacccccttcggccagcaacgggtgtttaaggaaaaagttgacacccgcacacctaaggctaaacagggcacggcccaggtgatggaggtcaccgcgagatggctgtgggggttccttagccggaataagaagccgagaatctgcacacgggaagagtttacccgcaaagtgagatctaacgccgctattggagccgtcttcgtggatgaaaatcagtggaacagcgctaaggaggccgttgaggacgaacggttttgggatctggtgcaccgcgagagagaactccataaacaaggcaagtgtgccacatgcgtctacaatatgatggggaaacgggagaagaagctgggagaattcggcaaagcgaaggggtcccgcgctatctggtatatgtggctgggcgccagatttctcgagttcgaggccctgggattcatgaacgaagaccactggttttctcgggagaatagcctttccggcgtggaaggggagggactgcaccgcctcggctacatcctgagagatatttctaaaatccccgggggaaacatgtatgctgacgataccgccggctgggacacacggattaccgaggatgaccttcagaatgaagctaagatcacggatattatggagcctgaacatgccctgctcgcgaccagcatcttcaaactgacataccagaacaaggtggttcgcgtgcagagacccgccaaaaatgggaccgtcatggacgtgatctcccggcgcgatcaaagaggctctggacaggttggcacatatgggctgaacacctttacgaacatggaggctcagctcattcggcagatggaaagcgagggaatcttctcccctagcgagctggaaacacccaatcttgccgagagagtgctggactggctcgaaaagtacggcgtcgagcgcctgaagcggatggctatttctggggacgattgcgtggtcaaaccgatcgacgatagatttgccaccgcgcttacagccctgaacgacatgggaaaggtgcgcaaagatattcctcaatgggaaccctccaagggctggaatgactggcagcaggttcctttctgtagccaccattttcaccagctcatcatgaaagatgggcgggagatcgtggtcccctgcagaaaccaagacgagctggtgggccgcgctcgggtttctcagggagccggctggtccctgagagaaaccgcttgtctcgggaagagctatgcccagatgtggcaactgatgtacttccaccgccgggatcttagactggctgccaatgcgatttgctccgccgtgcctgtcgactgggtgcccacgtctcgcaccacatggagcatccatgctcaccatcagtggatgaccacagagaacatgctctccgtgtggaatcgggtttggattgaagagaacccgtggatggaagataagacccacgtcagctcttgggaggacgtgccttacctgggaaaaagagaggaccagtggtgtggctcccttatcgggctgacagcccgggccacctgggctacgaatattcaggtggccatcaaccaagtcagacgcctcattggaaatgaaaactatctggattacatgacaagcatgaagcggtttaaaaatgactctgatcccgagggcgcgctgtggtga

SEQ ID NO: 18446 - RNA, 9879 nt, synthetic construct
  misc_feature 1..9879: note = derived and/or modified CDS sequence (opt5) from DENV-1__AB608786__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagacaagcgccggcgttaacatgtgcacccttattgccatggacctgggggaactctgtgaagatacaatgacctacaaatgccccagaatcacagaaaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcctggcgatgagatgcgttggcattgggtcccgggattttgtggagggactcagcggcgccacgtgggtcgacgtggtgctggagcacgggtcttgtgtcaccacaatggctaaggataaacccaccctggacatcgaactcctgaagacagaggttaccaaccctgccgtgcttcgcaaactgtgcattgaagctaagatctccaatacgacaaccgatagcagatgtccgacccaaggagaggccacactcgtggaagaacaggacgcgaacttcgtctgccggcgcacctttgtggatagaggctggggcaatgggtgtggactgttcggcaaagggtctcttattacatgcgccaagtttaagtgcgttacgaaactggagggaaagatcgtgcagtacgaaaacctcaaatattccgtcatcgtgaccgttcacacaggcgaccagcatcaagtggggaatgagagcaccgaacacggaacaaccgctacgattacaccccaggcccctacaaccgagatccagctgacagactacggcgctctgaccctcgattgttctccccggacgggcctggacttcaacgaaatggtccttctgacaatgaaggagaaatcctggctcgtgcataagcagtggtttctggatcttcctctgccctggaccagcggggcctccacatctcaagagacctggaatcgccaggacctcctggtcaccttcaaaacagcccacgctaagaagcaggaagtggttgtgctgggaagccaagagggcgcgatgcacacggccctcaccggggctacagaaattcagacctccggaacaaccacgatctttgccggccatctgaaatgcagacttaagatggataaactgacactcaaggggatgagctatgtcatgtgtaccggctctttcaaactggagaaggaagtggccgagacccagcacggaacagttctggtgcagattaagtacgagggcaccgacgctccgtgcaaaatccctttctccacacaagatgaaaagggggtcacgcagaacggacggcttatcaccgccaatcccattgtgacagacaaagagaagcctgtgaacatcgaagcggagccgccctttggcgagagctatattatcattggggctggagaaaaagccctcaagctgtcttggttcaagaaaggcagctccatcgggaagatgtttgaggccaccgctagaggcgcccgccggatggctatcctgggagatacagcctgggacttcggctctattgggggagtttttaccagcgtcggcaaactcgtgcatcagatcttcgggacggcgtacggagtgctgttttccggcgtcagctggaccatgaagattgggatcggcgtgcttctgacatggctcggactcaattctagatccaccagcctgtctatgacatgtattgccgttggccttgtgaccctctacctgggggtcatggtgcaggctgattccggatgcgttatcaactggaaaggccgcgaactgaagtgtgggagcggaattttcgtgacaaatgaggtccacacctggacggaacaatataagtttcaggccgactcccctaaacggctctctgctgccatcggcaaggcgtgggaggagggggtgtgcggcatcagaagcgccacacgcctggaaaacattatgtggaaacagatctccaacgagcttaatcatattctgctcgaaaacgacatgaagttcaccgttgtggtcggagatgtggctggcatcctggcccaggggaaaaagatgattcggccgcaacccatggagtacaaatattcttggaaaagctggggaaaggctaagatcatcggcgccgacgtgcagaataccacatttattatcgatgggcctaacacccccgaatgtcctgacgatcagagagcctggaatatttgggaggtcgaggactacggattcggcatctttacgacaaacatttggctgaaacttcgcgattcctatacccaggtttgcgaccaccggctcatgagcgctgcgatcaaagattctaaggccgtgcacgctgacatgggctactggatcgaatccgagaaaaatgaaacatggaagctggccagagccagcttcattgaggtgaagacctgtatctggcccaaatctcatacactgtggtccaacggggtcctcgaaagcgagatgattatcccgaagatttatggaggccctatctctcaacacaattaccgccccgggtacttcacccagacggctggaccttggcatctgggcaaacttgagctggattttgacctctgcgaagggaccacagtggttgtggatgagcactgcggaaaccggggccccagcctgagaaccacaaccgtcacgggcaagatcattcacgaatggtgttgccggtcctgtacactgcctccccttcgcttcagaggggaggacggatgctggtatggcatggagatccggccggtgaaagaaaaggaggaaaatctcgttaagagcatggtgtctgccgggtccggagaggtcgacagcttttccctgggcctgctctgtatttctatcatgattgaagaggtgatgagaagccgctggtcccggaaaatgctgatgaccgggacacttgcggttttctttctgctcatcatgggacagctgacctggaacgatctgattagactttgcatcatggtgggcgctaatgcctctgaccgcatgggcatggggaccacatacctggccctcatggctacgttcaagatgagacctatgtttgccgtcggactgctgttccggcgcctgaccagcagagaggtgcttctgctcacaatcggcctgtccctggtggcgtctgtcgaacttcccaacagcctggaggaactcggggatggactggctatgggcattatgatcctcaaactgcttaccgactttcaatcccatcagctgtgggccacactcctgagcctgaccttcattaagacgacattttctcttcactatgcctggaaaaccatggctatggttctgtccatcgtgagcctcttccccctgtgtctctctaccacatcccagaagaccacatggctgcctgtgcttctggggagcctgggatgcaagccgctcacgatgtttctgattgccgagaataaaatctggggccggaagtcttggccccttaacgaaggcatcatggctgtcgggattgtgtccatcctgctcagctccctgctcaaaaacgatgttcctctggccggaccccttattgcgggcgggatgctgatcgcctgttacgtgattagcggatctagcgctgacctgtccctcgagaaggccgctgaggtctcttgggaagaggaagccgagcatagcggcgcctcccacaatatcctggtggaagttcaggatgacgggaccatgaaaatcaaggatgaggagcgcgacgatacacttaccattctgctcaaagctacactgctcgcggtgtctggagtctatcctctgagcatccccgccacccttttcgtgtggtacttctggcaaaagaagaaacagagatccggcgtcctgtgggacacgccttctcccccggaagtggagcgggctgttctggatgacggcatttatcgcatcatgcagagagggctcctgggacggagccaggtgggcgtcggggtgtttcaagaaaacgttttccataccatgtggcacgtgacacgcggagccgtccttatgtaccagggcaagagactggagccttcctgggccagcgtgaaaaaggacctcatttcttacgggggaggctggcggctgcagggctcctggaataccggggaggaagtgcaggttatcgctgtcgagcccggcaagaaccctaagaatgtgcaaacagcccccggcacctttaagacaccggaaggggaggtgggagcgattgctctcgatttcaaacctggcacgagcgggtctcccatcgtcaacagagaaggaaagatcgtgggcctgtatggcaatggggttgtgaccacatccggaacctacgtcagcgccattgcccaggctaaagcctcccaggagggccctcttcccgagatcgaagacgaggtgtttcgcaagcggaacctgaccattatggatctgcaccccgggtctggaaaaacaagacgctatctccctgcgatcgttcgggaagctattaagagaaagctgcgcacgcttatcctggccccgacccgggtggtcgccagcgagatggctgaagccctcaaaggcatgcccatcagataccaaacaaccgctgtgaagtccgagcatacagggaaagagattgttgacctgatgtgccacgccaccttcacgatgcgcctgctcagccctgtgcgggtccccaattataacatgatcattatggatgaagcgcattttacagacccttcttccatcgccgctagaggctacattagcacccgggtgggaatgggcgaggccgctgccatcttcatgaccgccacaccccctgggtctgtggaggcttttccgcagagcaatgcggtcatccaggatgaggaacgcgacattcccgagagatcctggaactctggatatgagtggatcaccgatttccctggcaagacagtttggtttgtgcccagcattaaatccgggaatgacatcgccaactgtcttcggaagaatggaaagcgcgtgattcagctgtctagaaaaaccttcgatacggaataccaaaagaccaagaacaacgactgggactacgtcgtgaccacagatatcagcgagatgggcgctaatttccgggccgacagagttattgatcctcgccggtgcctgaagcccgtgatcctcaaagacgggccggaaagagtcatcctggccggccctatgcccgtgaccgttgcttccgccgcgcagcgccggggaagaattggccgcaaccacaataaggagggggatcagtatatctacatgggacagccccttaacaatgacgaggatcatgctcactggacggaagccaagatgctgctcgacaacattaatacccctgagggcatcattcccgccctgtttgaacctgagcgggagaaaagcgctgccatcgatggggagtatagactgcgcggagaggcgagaaagacattcgtggaactcatgcggcgcggcgaccttccggtctggctgtcttacaaagtggcctccgaggggtttcaatatagcgatagacggtggtgcttcgacggcgaacgcaacaatcaggtcctggaggaaaacatggatgtggagatctggaccaaggagggagaacgcaaaaagctccggcccagatggctggacgctcgcacatactccgaccctcttgccctgcgggagtttaaagagttcgctgccggcagacgctctgttagcggggatctcattctggagatcggaaagctgccccagcacctcacccagcgggctcaaaatgcccttgacaacctggtgatgctgcataattccgaacagggcgggagagcgtatcggcacgccatggaggagctccctgatacaattgaaaccctgatgcttctggctctcatcgccgtgctgacgggaggcgtcacactgtttttcctctctggccgcgggcttggaaagaccagcattggcctgctgtgtgttatggcttccagcgtgctcctgtggatggcctctgtggagccccattggatcgccgcttccatcattcttgaatttttcctgatggtcctcctgatcccggagcctgacagacagcggacaccccaggataaccaactggcgtacgtggttattgggctcctttttatgatcctgacagtggccgctaatgagatgggactgctcgaaaccaccaaaaaggacctgggcattgggcacgtcgccgtggagaaccaccatcacgccgctatgcttgatgtcgacctgcatcctgccagcgcgtggacgctctacgccgtggctaccacaatcattacccccatgatgcgccacacaatcgaaaacaccacggccaatatctctctgaccgctattgccaaccaggcggccatcctgatgggactcgataaaggctggcctatttccaagatggacatcggcgttccccttctggctctggggtgctatagccaggtgaatccgctcacactgaccgccgctgtccttatgctggtggcccattacgctattatcggacctggcctccaagccaaagcgacaagagaggcccagaagcggaccgctgccgggatcatgaagaaccccacggttgatggaattgtggctatcgacctggatcccgtcgtgtatgacgccaaattcgaaaagcagctgggccagattatgctccttatcctgtgtacatctcaaattctgctcatgcgcaccacatgggccctgtgcgagagcatcacccttgcgaccgggcctctgacaacgctctgggagggatccccgggcaaattttggaataccacaatcgctgtgtctatggccaacattttcagaggcagctacctggctggggccggactggccttctccctcatgaaaagccttggcgggggacggcgcggcaccggggctcagggagaaacactgggcgagaaatggaagagacagctgaatcagctctccaagtctgaatttaacacctataaaggcagcgggatcatggaggttgaccggtccgaagccaaggagggactgaaaagaggcgagacgacaaagcacgcggtctctcgcgggaccgccaaacttcggtggttcgtggaaagaaatctggtgaagcccgagggaaaggtcattgatctcggctgtgggcgcggaggctggagctactattgcgctggcctgaaaaaggttaccgaagtgaaagggtacacaaagggaggccctgggcacgaggaacccatccctatggccacctacggatggaacctggtgaaactccattccggcaaggacgtctttttcattccccctgagaaatgtgatacacttctgtgcgacatcggggagtctagcccgaatcccacgattgaagagggacggaccctgagagtgctcaagatggttgaaccttggctgcgcggcaaccaattttgtatcaagatccttaatccctatatgccttccgtggtcgagacactggagcagatgcagcggaaacacggcgggatgctcgtgagaaaccccctgagccgcaattctacccatgaaatgtactgggtttcctgcggaacaggcaacattgtgagcgctgtcaatatgacctctcggatgctgctcaacagattcacgatggcccaccgcaagccgacctatgagcgggatgtggacctgggggcgggaacaagacacgtggccgtcgaacctgaggttgctaaccttgatatcattggccagcgcatcgaaaatattaaacatgagcacaagtccacctggcattacgacgaggataacccctataaaacatgggcctaccacgggagctatgaagtgaagccctctggatccgctagctccatggtgaatggcgtcgtgaagctgctcaccaaaccttgggacgttatccccatggtgacacaaatcgccatgaccgatacgacaccttttggccagcagagagtcttcaaggagaaagtggacacccggaccccgaaggctaaacgcgggacagcccaaattatggaagttacggcgaagtggctgtggggatttcttagcagaaacaagaaaccccggatctgtaccagagaggagttcacacggaaggtgcgctctaatgccgctattggcgccgtctttgtggacgagaaccagtggaatagcgctaaagaggccgttgaagatgagagattctgggacctggtgcatcgggaacgcgagctccacaagcaggggaaatgcgcgacctgcgtctacaacatgatgggaaagagagaaaagaaactgggcgagtttgggaaggcgaaaggctcccgggctatctggtacatgtggctgggagcccgcttcctcgagttcgaagccctgggctttatgaatgaggatcactggttctctagagaaaacagcctttccggggtggagggagagggcctgcataagctcgggtatattctgcgggacatctctaaaatccctggaggcaatatgtacgctgatgacacagccgggtgggatacccgcattacagaagacgatcttcagaacgaggctaagatcaccgacattatggaacccgagcacgccctgctcgcgaaaagcatctttaagctgacgtatcaaaataaggtcgtgagagttcagcggcctgccaaaaacggcaccgtgatggatgtcatttcccgcagagaccagcggggatctggccaggtggggacatacggactgaataccttcacaaacatggaagctcaactcatccgccagatggagagcgagggcatcttttcccccagcgaactggagaccccgaaccttgccgaaagagtgctggattggctcgagaagtatggggttgaacggctgaaaagaatggctatttctggagacgactgtgtggtcaagcctatcgatgaccgcttcgccacggcgcttacagccctgaatgatatgggcaaagtgcggaaggacattccccagtgggagccttccaaggggtggaacgattggcagcaagttcccttttgcagccatcacttccaccagctcatcatgaaagacggcagagagattgtggtcccttgtcgcaatcaggatgaactggtgggacgggctagagtctctcagggcgccgggtggtccctgcgcgagaccgcttgcctcggaaagagctacgcccaaatgtggcagctgatgtattttcatcggagagaccttcgcctggctgccaacgcgatctgttccgccgtgcccgttgattgggtgccgacatctcggaccacgtggagcattcacgctcatcaccagtggatgaccacagaagacatgctctccgtctggaatagagtgtggatcgaggaaaacccttggatggaggataaaacccatatcagctcttggggcgacgttccctacctggggaagcgcgaggaccaatggtgcggatcccttattggcctgacagcccgggccacctgggctacaaatatccaggtggccattaaccaggtcagacggctcatcgggaatgaaaactacctggattatatgaccagcatgaaaagattcaagaatgagtctgaccccgaaggcgcgctgtggtga

SEQ ID NO: 18447 - RNA, 9879 nt, synthetic construct
  misc_feature 1..9879: note = derived and/or modified CDS sequence (opt5) from DENV-1__AB608787__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagaccagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccagggagaggccaccctggtggaagaacaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagcacaaatactcttggaaaagctggggaaaggccaagatcattggcgctgacgtgcaaaattccacctttatcatcgatgggcctaacacccccgaatgtcctgacgatcagagagcgtggaatatttgggaggtcgaggactatggattcggcatctttacaaccaacatttggctgaaacttcgcgatagctacacgcaggtttgcgaccaccggctcatgtctgccgctatcaaagattccaaggccgtgcatgccgacatgggctattggattgaaagcgagaaaaatgaaacatggaagctggctagagcctctttcatcgaggtgaagacctgtatctggcccaaatcccacacactgtggagcaacggggtcctcgaatctgagatgattatcccgaagatttacggaggccctatcagccaacataattatcgccccgggtacttcacccagacagcgggaccttggcacctgggcaaacttgagctggattttgacctctgcgaagggaccacggtggttgtggatgagcactgcggaaaccggggcccctccctgagaaccacaaccgtcacaggcaagattgtgcatgaatggtgttgccggagctgtaccctgcctccccttcgcttcagaggggaggacggatgctggtacggcatggagatccggccggttaaagaaaaggaggaaaatctcgtgaagtctatggtctccgctgggagcggagaggtggactccttttctctgggcctgctctgtatcagcattatcattgaagaggttatgagatcccgctggatccggaaaatgctgatgacggggacacttggagtgttctttctgctcattatgggccagctgacctggaacgatctgatcagactttgcattatggtcggcgccaatgcctctgaccgcatggggatgggaacaacctatctggctctcatggccaccttcaagatgagacctatgtttgcggtgggcctgctgttccggcgcctgacaagcagagaggtgcttctgctcacgatcgggctgtccctggtcgcttctgttgaacttcccaacagcctggaggaactcggagatggcctggccatggggatcatgattctcaaactgcttaccgactttcaatcccaccagctgtgggccacactcctgagcctgaccttcatcaagacaaccttttctcttcattacgcttggaaaacgatggccatggtgctgtccattgtgagcctcttccccctgtgtctctctacaacctcccagaagaccacatggctgcctgtccttctgggaagcctgggctgcaagccgctcaccatgtttctgatcgctgagaataaaatttggggccggaagtcttggccccttaacgaagggatcatggccgtgggaatcgtttccattctgctcagctccctgctcaaaaacgatgtgcctctggcgggcccccttatcgccgggggaatgctgattgcttgttatgtcatcagcggctctagcgccgacctgtccctcgagaaggctgccgaggtgtcttgggaagaggaagccgagcacagcggggcttcccataatattctggttgaagtgcaggatgacggaacaatgaaaatcaaggatgaggagcgcgacgatacgcttaccatcctgctcaaagcgacactgctcgccgtctctggcgtgtaccctctgagcattcccgctacccttttcgtctggtatttctggcaaaagaagaaacagagatccggcgtgctgtgggacacaccttctcccccggaagttgagcgggccgtgctggatgacgggatctaccgcattatgcagagaggactcctgggccggagccaggtcggggtgggagtttttcaagaaaacgtgttccacaccatgtggcacgtcacgcgcggcgccgtgcttatgtatcaggggaagagactggagccttcctgggctagcgtgaaaaaggacctcatctcttacggaggcggctggcggctgcaggggtcctggaataccggagaggaagttcaggtcattgccgtggagcccggcaaaaaccctaagaatgtgcaaacagcgcccgggacctttaagacaccggaaggagaggtcggcgctatcgccctcgatttcaaacctgggaccagcggatctcccattgtgaacagagaaggcaagatcgttggcctgtacgggaatggagtggtcacaacgtccggcacctatgtgagcgccatcgctcaggccaaagcgtcccaggaggggcctcttcccgagattgaagacgaggtttttcgcaagcggaacctgacaatcatggatctgcatcccggatctggcaaaaccagacgctacctccctgctattgtgcgggaagccatcaagagaaagctgcgcacccttattctggccccgacacgggtcgtggctagcgagatggccgaagctctcaaagggatgcccatcagatatcaaacgaccgccgttaagtccgagcacacaggcaaagagatcgtggacctgatgtgccatgcgaccttcacaatgcgcctgctcagccctgtccgggtgcccaattacaacatgattatcatggatgaagcccactttaccgacccttcttccattgctgccagaggatatatcagcacgcgggtgggcatgggggaggctgccgccattttcatgacagctacaccccctggatctgtcgaagcgtttccgcagagcaatgccgttatccaggatgaggaacgcgacatccccgagagatcctggaactctggctacgagtggattaccgatttccctgggaagacagtgtggtttgtgcccagcatcaaagctggaaatgacattgccaactgtcttcggaagaatggcaagcgcgtcatccagctgtccagaaaaaccttcgatacagaatatcaaaagaccaaaaacaacgactgggactacgtggttacgacagatatttctgagatgggggccaatttccgggctgacagagtgatcgatcctcgccggtgcctgaagcccgtcattctcaaagacggcccggaaagagtgatcctggccggacctatgcccgttaccgtggcgagcgctgcccagcgccggggcagaatcgggcgcaaccataataaggagggagatcagtacatttatatgggccagccccttaacaatgacgaggatcacgcccactggacagaagctaagatgctgctcgacaacatcaatacccctgaggggattatccccgccctgtttgaacctgagcgggaaaaatccgcggccattgatggagagtacagactgcgcggcgaggctagaaagacgttcgtcgaactcatgcggcgcggggaccttccggtgtggctgagctataaagtcgcctctgagggctttcaatactccgatagacggtggtgcttcgacggagaacgcaacaatcaggtgctggaggaaaacatggatgttgagatctggaccaaggagggcgaacgcaagaagctccggcccagatggctggacgctcgcacatatagcgaccctcttgccctgcgggagtttaaagagttcgctgccgggagacgctccgtgtctggagatctcatcctggagattggcaagctgccccagcatctcacccagcgggcgcaaaatgcccttgacaacctggtgatgctgcacaatagcgaacaagggggcagagcttaccggcatgccatggaggagctccctgatacaatcgaaaccctgatgcttctggctctcattgccgtcctgacaggcggcgttaccctgtttttcctctccgggaagggacttggcaaaacgtctatcgggctgctgtgtgtgatggccagctccgtgctcctgtggatggctagcgtcgagccccactggattgcggcctctatcatccttgaatttttcctgatggtgctcctgattccggagcctgaccgccagagaacaccccaggataaccaactggcttatgttgtgatcggactcctttttatgattctgaccgtcgccgccaatgagatgggcctgctcgaaaccacaaagaaagacctggggatcggacacgtggctgtcgagaaccatcaccatgccgcgatgcttgatgtggacctgcaccctgcctccgcttggaccctctacgccgttgctacaacgattatcacccccatgatgcggcatacaattgaaaacaccacagccaatatcagcctgaccgcgatcgccaaccaggctgccattctgatgggcctcgataagggctggcctatctctaaaatggacattggggtgccccttctggctctgggatgctactcccaggtcaatccgctcacgctgaccgccgctgtgcttatgctggttgcccactatgcgatcattggccctgggctccaagccaaggctacacgcgaggcccagaagagaaccgctgccggaatcatgaaaaaccccacagtggatggcatcgtcgccattgacctggatcccgtggtgtacgacgcgaagttcgaaaaacagctggggcagatcatgctccttattctgtgtaccagccaaatcctgctcatgcggacgacatgggctctgtgcgagtctattacccttgccacaggacctctgaccaccctctgggagggcagcccgggcaagttttggaatacaacgatcgctgtttccatggccaacatcttccgcgggtcttatctggccggagctggcctggccttcagcctcatgaaatcccttgggggaggcagacgggggaccggagcgcagggcgaaacactgggcgagaagtggaagcgccagctgaatcagctcagcaaatccgaatttaacacctacaaggggtctggaattatggaggtcgacagaagcgaagccaaagagggcctgaagagaggggaaacaaccaaacacgctgtgtcccggggaacggccaaacttcgctggttcgtggaacggaatctggtcaagcccgagggcaaagttatcgatctcgggtgtggaagaggcggctggtcttattactgcgctgggctgaagaaagtgacagaagtgaagggatataccaaaggcgggcctggacatgaggaacccattcctatggccacctacggctggaacctggtcaagctccacagcgggaaagacgtgtttttcattccccctgagaagtgtgatacacttctgtgcgacatcggagagtcctctccgaatcccaccatcgaagagggccgcacactgcgggttctcaagatggtggaaccttggctgaaaggcaaccaattttgtattaagatccttaatccctacatgcctagcgtcgtggagacgctggagcagatgcagagaaaacatgggggaatgctcgttcgcaaccccctgtcccggaatagcacccacgaaatgtattgggtgtcttgcggcacagggaacatcgtctccgcggtgaatatgaccagcagaatgctgctcaaccgcttcacaatggcccaccggaagccgacctacgagagagatgtggacctgggagctggcacgcgccatgtcgccgttgaacctgaggtggctaaccttgatattatcgggcagcggattgaaaatatcaaacacgagcataagtctacctggcactatgacgaggataacccctacaagacatgggcctatcatggatcctacgaagtgaaacccagcggctctgcttccagcatggtcaatggcgtggttaagctgctcaccaaaccttgggacgtgattcccatggtcacacaaatcgccatgaccgatacaaccccttttgggcagcagagagtgttcaaggagaaagttgacacgcgcacaccgaaggcgaagagaggaaccgcccaaatcatggaagtgaccgctcggtggctgtggtcctttcttagccgcaacaaaaagcccagaatttgtacacgggaggagttcacgagaaaagtccggtctaatgccgctatcggcgccgtgtttgttgacgagaaccagtggaatagcgccaaggaggcggtggaagatgagcgcttctgggacctggtccacagagaacgggagctccacaaacaggggaagtgcgctacctgcgtgtataacatgatgggaaagcgcgagaagaagctgggcgagtttgggaaagccaagggctccagagccatttggtacatgtggctgggagctcggttcctcgagttcgaagccctgggctttatgaatgaggatcattggttctctcgcgaaaacagcctttccggggtcgagggagagggcctgcacaaactcgggtacatcctgagagacatttctaagatccctggaggcaatatgtatgctgatgacacagccgggtgggatacccggatcacagaagacgatcttcagaacgaggcgaaaattaccgacatcatggaacccgagcatgccctgctcgctaagagcatttttaagctgacataccaaaataaagtggttcgcgtgcagagacctgccaagaacggcaccgtcatggatgtgatctcccggcgcgaccagagaggatctggccaggtggggacgtatggactgaataccttcacaaacatggaagctcaactcattcggcagatggagagcgagggcatcttttcccccagcgaactggagaccccgaaccttgccgaacgcgttctggattggctcgagaaatacggggtggaaagactgaagcggatggcgatctctggagacgactgtgtcgtgaaacctattgatgacagattcgccacagctcttaccgccctgaatgatatgggcaaggttcgcaaggacatcccccagtgggagccttccaaagggtggaacgattggcagcaagtgcccttttgcagccaccacttccatcagctcattatgaaggacggccgggagatcgtcgtgccttgtagaaatcaggatgaactggtcggacgcgctcgggtgtctcagggcgccgggtggtccctgagagagacggcttgcctcggaaaaagctatgcccaaatgtggcagctgatgtactttcaccgccgggaccttagactggcggccaacgctatttgttccgccgttcccgtggattgggtcccgacatctcgcaccacatggagcatccatgcccaccatcagtggatgaccacggaagacatgctctccgtgtggaatcgggtttggattgaggaaaacccttggatggaggataagacccacatcagctcttgggaggacgtgccctatctgggcaaaagagaagaccaatggtgcgggtcccttatcggactgacagctcgccccacctgggccacaaatattcaggtcgcgatcaaccaggtgcggagactcattggcaatgagaactacctggattacatgaccagcatgaagcggttcaagaatgaatctgagcctgagggggctctgtggtga

SEQ ID NO: 18448 - RNA, 9879 nt, synthetic construct
  misc_feature 1..9879: note = derived and/or modified CDS sequence (opt5) from DENV-1__HE795086__SS-prME
  source 1..9879: mol_type = other RNA
agcgtgacaatgctgctgatgctgatgcccacggcccttgctttccacctgacgaccagaggcggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcgttagatccgccacccgcctggaaaacatcatgtggaagcagatctctaacgagctcaatcatattctgcttgaaaacgacatgaaatttacggtggtcgtgggagatgtggctggcatcctggcccaggggaagaaaatgattcggccgcagcccatggagtacaagtatagctggaagtcctggggaaaagccaagatcattggcgctgacgtccaaaatacaaccttcatcatcgatgggcctaacacccccgaatgtcctgacgatcagagagcgtggaatatttgggaggttgaggactacggatttggcatcttcacaaccaacatttggctcaaactgcgcgatagctatacacaggtgtgcgaccaccggctgatgtctgccgctatcaaggattccaaagccgtgcacgccgacatgggctactggattgaaagcgagaagaatgaaacatggaaacttgctagagcctctttcatcgaggtcaaaacctgtatctggcccaagtcccatacactctggagcaacggggtgctggaatctgagatgattatcccgaaaatttatggaggccctatcagccagcacaattaccgccccgggtactttacccaaacagcgggaccttggcatctgggcaagctcgagctggatttcgacctttgcgaagggaccacggttgtggtcgatgagcactgcggaaaccggggcccctccctgagaaccacaaccgtgacaggcaaaattatccacgaatggtgttgccggagctgtaccctccctcccctgcgctttaagggggaggacggatgctggtatggcatggagatcagaccggttaaggaaaaagaggaaaatctggtgaagtctatggtctccgctgggagcggagaggtggactccttctctcttggcctcctgtgtattagcatcatgattgaagaggttatgcggtccagatggtctcgcaaaatgctgatgacggggacactcgccgtgtttttcctgcttatcatgggacagctgacctggaacgatctcattcggctgtgcatcatggtcggcgccaatgctagcgacagaatgggcatggggacaacctacctggcccttatggcgacctttaagatgcgccctatgttcgctgtgggactgctctttagacggctgacatcccgcgaggtgctcctgcttacgattggcctgtctctcgtcgccagcgttgaactgcccaactccctggaggaacttggggatggactggccatgggcatcatgatcctcaaactgctcaccgacttccagagccatcaactgtgggctacacttctgtctctcacctttattaagacaaccttctccctgcactatgcctggaagacgatggctatggtgctgagcatcgtgtctctttttcccctgtgtctctccacaaccagccagaaaaccacatggctgcctgtcctcctggggtctcttggatgcaagccgctgaccatgttcctgattgccgagaataaaatctggggcagaaagtcctggcccctcaacgaaggcattatggcggtggggatcgttagcatcctgctttccagcctgctcaaaaacgatgtgcctctggccggacccctcattgctggcgggatgctgatcgcctgttacgtcatttctggaagctccgctgacctttctctggagaaggccgccgaggtgagctgggaagaggaagctgagcattccggcgcgtctcacaatatcctggttgaagtgcaggatgacgggacaatgaaaattaaggatgaggagcgggacgatacgctcaccatcctgcttaaggccacactgctcgctgtcagcggagtgtatcctctgtccatccccgccaccctcttcgtctggtacttttggcagaaaaagaaacaacgctctggcgtgctgtgggacacaccttcccctcccgaagttgagagagccgtgcttgatgacggcatttatcggatcatgcagcgcgggctgctgggaagatcccaggtcggcgtgggggttttccaggaaaacgtgtttcataccatgtggcacgtcacgcggggagctgtgctcatgtaccaaggcaagcgcctggagcccagctgggcctctgtgaaaaaggaccttatttcctacgggggaggctggagactgcagggcagctggaataccggggaggaagttcaggtcatcgcggtggagcccggaaagaaccctaaaaatgtgcagacagctcccggcaccttcaagacatctgaaggggaggtcggagccattgccctcgattttaaaccgggcacctccgggagccctatcgtgaaccgggaaggaaagattgttggcctgtatggcaatggggtggtcacaacgtccggaacctacgtgtctgctatcgcccaagcgaaagctagccaggacggccccctccctgagatcgaggatgaagttttcagaaagcgcaacctgacaattatggaccttcaccccgggtccggaaagacccggagatatctgcccgccatcgtgcgcgaggccattaaacggaagctgagaaccctcatcctggctcctacacgcgtcgtggccagcgaaatggctgaggcccttaaaggcatgccgattcggtaccagacgaccgcggttaagtctgaacatacagggaaagagatcgtggatctgatgtgccacgccacctttacaatgagactcctgtcccccgtccgcgtgcctaattataacatgatcattatggacgaggctcatttcaccgatcccagctctatcgccgctcggggctacattagcacgagagtgggaatgggcgaagccgccgctatctttatgacagcgacccctcccgggtccgtcgaggccttccctcaatctaatgctgttattcaggacgaagaacgggatatcccggaacgcagctggaactccggatatgagtggatcaccgactttcccggcaagacagtgtggttcgtgccttctattaagagcgggaatgatatcgccaactgtctgcgcaagaatggaaagcgggtcattcagctctcccgcaaaaccttcgacacagagtaccagaagaccaaaaacaacgactgggattacgtggttacgacagacatcagcgaaatgggcgccaattttagagctgatcgggtgattgaccccagacgctgccttaagcctgtcatcctgaaggatgggcccgagcgggtgattctggccggcccgatgcctgttaccgtggcgtctgctgcccaaagacgcggacggatcggcagaaaccacaataaagaaggggaccagtatatctacatgggacagcccctcaacaatgatgaggaccatgcccactggacagaggctaagatgctgcttgataacattaatacccccgaaggcatcattcctgccctgttcgagcccgaacgcgagaaatccgcggccatcgacggggaatatcggctcagaggagaggctcgcaagacgtttgtcgagctgatgagacggggcgatctgcctgtgtggctcagctacaaagtcgcctccgaagggttccagtattctgaccgcagatggtgctttgatggcgagcggaacaatcaagtgcttgaagagaacatggacgttgaaatttggaccaaggagggagagcgcaaaaagctgagaccgcggtggctggacgctagaacatacagcgatcccctcgccctgcgcgagttcaaggagtttgctgccggccggagatccgtgtctggggaccttatcctggaaatcggaaaactccctcagcacctgacccagcgcgcgcagaatgccctggataacctcgtgatgcttcataatagcgagcaaggcgggcgggcttatagacacgccatggaggaactgcccgacacaattgagaccctgatgctcctggctcttatcgccgtcctgacaggaggcgttaccctcttctttctgtccggccgggggctgggaaagacgagcattggcctcctttgtgtgatggcctcttccgtgctgctgtggatggctagcgtcgaacctcattggatcgcggcctctattatcctcgagttctttctgatggtgcttctgatccccgaaccggatcgccagagaacacctcaggacaaccagctcgcttacgttgtgattgggctgctgttcatgatcctcaccgtcgccgccaatgagatgggacttctggagaccaccaagaaggatctgggcattgggcacgtggctgtcgaaaaccaccatcacgccgcgatgctcgacgtggatctgcatcccgcctccgcttggaccctttacgccgttgctacaacgatcattacccctatgatgcggcacacaatcgagaacaccacagccaatattagcctgaccgcgatcgccaaccaagctgccatcctcatgggactggacaaaggctggcccatttctaagatggatatcggcgtgcctctgctcgctcttgggtgctatagccaggtcaatcccctgacgctgaccgccgctgtgctcatgctggttgcccattacgcgattatcggaccgggccttcaggccaaggctacacgcgaagcccagaagagaaccgctgccgggattatgaagaaccctacagtggacggaatcgtcgccatcgatctggaccccgtggtgtatgacgcgaaatttgagaagcagctcggccagattatgctgctgatcctctgtacctcccagattcttctgatgcggacgacatgggctctgtgcgaatctatcaccctcgccacagggcccctgaccaccctttgggagggaagccctggcaaattctggaatacaacgattgctgtttccatggccaacatcttccgcggcagctacctggccggggctggactcgccttttccctgatgaagtctctgggcgggggaagacggggcaccggggcgcaaggagagacactcggcgaaaagtggaaacgccagcttaatcagctgagcaagtccgagttcaacacctataaaagatctggcatcatggaagtcgatcggagcgaggccaaggaagggctgaaaagaggagagacaaccaagcacgctgtgtcccgcggcacggccaagctccggtggtttgtggagagaaatctggtcaaaccggaagggaaggttattgaccttggatgtggccgcgggggatggtcttactattgcgctggcctgaaaaaggtgacagaggtgaaaggctacaccaaagggggacccggccacgaggaacctatccccatggccacctacgggtggaacctcgtcaaactgcatagcggaaaggatgtgttctttattcctcccgaaaagtgtgacacactgctctgcgatatcggcgagtccagccctaatccgaccattgaggaagggcggacacttagagttctgaaaatggtggagccctggctgcgcggaaaccagttctgtatcaagattctcaatccttatatgccctctgtcgtggaaacgctggagcaaatgcagcggaaacacggcggcatgcttgttagaaaccctctgtcccgcaatagcacccatgagatgtactgggtgtcttgcgggacaggaaacatcgtctccgcggtgaatatgaccagccggatgctcctgaacagatttacaatggcccaccgcaagcccacctatgaacgggacgtggatctgggcgctgggacgagacacgtcgccgttgagccggaagtggctaacctcgacatcattggacagcgcatcgagaatattaaatacgaacataagtctacctggcactatgatgaggacaacccttacaagacatgggcctatcatggctcctacgaggtgaaacccagcgggtccgctagctctatggtcaatggagtggttaagctgcttaccaaaccctgggatgtgatccctatggtcacacagattgccatgaccgacacaacccccttcggccaacagagagtgtttaaggaaaaagttgacacgcggacacctaaggcgaagcgcggcaccgcccagatcatggaggtgaccgctaaatggctgtgggggttcctcagcagaaacaagaaaccgcggatctgtacaagagaagagtttacgcggaaggtccgctccaatgccgctattggagccgtgttcgttgatgaaaaccaatggaactctgccaaagaggcggtggaggacgaaagattttgggatctggtccaccgggagcgcgaacttcataagcagggcaagtgcgctacctgcgtgtacaacatgatggggaaaagagagaagaaactgggagagttcggcaaggccaaagggagccgggccatctggtatatgtggctcggcgctcgcttcctggagtttgaggccctgggattcatgaatgaagaccactggttttccagagagaactctctcagcggcgtcgaaggggagggactgcacaaacttggctacattctgcgggatatctccaaaattcccgggggaaatatgtatgctgacgatacagccggctgggacacccgcatcacagaggatgacctccagaacgaagcgaagatcaccgatattatggagcctgaacatgccctgcttgctaagtctatcttcaaactgacataccagaataaggtggttagagtgcaacggcccgccaaaaacgggaccgtcatggacgtgattagccgcagagatcagcggggctccggacaggtgggcacgtatgggctcaatacctttacaaacatggaggctcagctgatccgccaaatggaaagcgagggaattttctctccttccgagctggaaacccccaacctcgccggcagagttctggactggcttgagaagcacggggtggaacggctgaaaagaatggcgatcagcggagacgattgtgtcgtgaagccgatcgacgatcgctttgccacagctctcaccgccctgaatgacatgggcaaggttcggaaagatattcctcagtgggagccctctaaggggtggaacgactggcaacaggtgcctttctgctcccatcactttcaccaacttatcatgaaagatggcagagaaattgtcgtgccctgtcgcaatcaggacgagctggtcggacgggctagagtgagccagggcgccgggtggtccctccgcgagacggcttgcctgggaaagtcttacgcccagatgtggcaactgatgtatttccatcggagagatctccgcctggcggccaacgctatctgtagcgccgttcctgtggactgggtccccacatcccggaccacatggagcattcacgcccatcaccagtggatgaccacggaagatatgctttctgtgtggaatagagtttggatcgaggaaaacccgtggatggaggacaaaacccatatttccagctgggaagacgtgccttacctgggcaagcgcgaggatcagtggtgcgggtctctcatcggactgacagctcgggccacctgggcgacaaatatccaagtcgctattaaccaggtgagacggcttatcggcaatgagaactacctggactatatgaccagcatgaagagatttaaaaatgaatccgatcccgagggggccctctggtga

SEQ ID NO: 18449 - RNA, 9879 nt, synthetic construct
  misc_feature 1..9879: note = derived and/or modified CDS sequence (opt5) from DENV-1__AB189120__SS-prME
  source 1..9879: mol_type = other RNA
agcgtgaccatgctgctcatgctgcttcccacagtgctgacgttccacctcaccacaagaggcggggaacctcatatgatcgtttccaagcaggaacggggaaaatctctgctttttaagaccagcgccggcgtgaatatgtgcacactgattgctatggacctcggggaactgtgtgatgacaccatgacatacaaatgcccgagaatcaccgaaacggagcccgatgacgtggattgttggtgcaatgccaccgaaacatgggtcacctatggaacatgttcccagaccggcgagcacagacgggacaagcgctctgtggccctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagaacaagacgccaatttcgtctgccggcgcacatttgtggatagaggctggggcaacgggtgtggactgttcggcaaagggagccttattacgtgcgcgaagtttaagtgcgttaccaaactggagggaaagatcgtgcagtacgaaaatctcaaatattctgtcatcgtgacagttcacaccggcgaccagcatcaagtggggaacgagacaaccgaacacggaacgattgccaccatcacaccccaggctcctacctccgagattcagctgacagactacggcgccctgaccctcgattgtagcccccggacgggcctggacttcaatgaaatggtccttctgacaatgaaggagaaatcttggctcgtgcataagcagtggtttctggatcttcctctgccctggacctccggggctagcacatcccaagagacctggaaccgccaggacctcctggtcaccttcaaaacagcccacgccaagaagcaggaagctgtggttctgggatctcaagagggcgcgatgcacacggccctcaccggggctacagaaatccagaccagcggaacaaccacgatttttgccggccatctgaaatgcagacttaagatggataaactgacactcaaggggatctcctatgtgatgtgtaccggcagcttcaaactggagaaggaagtcgccgagacccagcacggaacagtgctggttcaggtgaagtacgagggcaccgacgctccgtgcaaaatccctttctcttcccaagatgaaaagggggtcacacagaatggacggcttgtgacggccaaccccattgtgaccgacaaagagaagcctgttaatatcgaagcggagccgccctttggcgagagctatattgtcgtgggggctggagaaaaagccctcaagctgtcttggttcaagaaaggcagctccatcgggaagatgtttgaggccacagctagaggcgcccgccggatggctattctgggagataccgcctgggacttcggctctatcgggggagtgtttacaagcgtcggcaaactcgtgcatcagatcttcgggaccgcgtacggagttctgttttccggcgtgagctggacgatgaagattgggatcggcattcttctgacctggctcggactgaactctagatccacaagcctgtctatgacctgtatcgccgtcggcatggtgacactttacctcggggttatggtgcaggctgattccggatgcgtcattaattggaaaggccgcgaactgaagtgtgggagcggaatcttcgtgaccaacgaggttcacacatggaccgaacaatataagtttcaggccgactcccctaaacggctgtctgctgccattggcaaggcgtgggaggagggggtgtgcggcatcagaagcgccacgcgcctcgaaaacatcatgtggaaacagatttccaatgagctgaaccatatccttctggaaaatgacatgaagttcacagtcgtggtgggagatgtctctggcattctcgctcaggggaaaaagaccatccggccgcaacccatggagcacaaatacagctggaagtcctggggaaaggccaaaattatcggcgctgacgttcagaacaccacatttatcattgatgggcctaatacccccgaatgtcctgacgatcagagagcctggaacatctgggaggtggaggactatggattcggcatttttacgacaaatatctggctgaagctgcgcgatagctacacccaggtgtgcgaccaccggcttatgtctgccgctattaaagattccaaggcggtccatgccgacatgggctattggatcgaaagcgagaaaaacgaaacatggaagctcgctagagcctctttcatcgaggtgaagacctgtgtttggcccaaatcccacacactgtggagcaatggggtgctggaatctgagatgattatcccgaagatttacggaggccctatcagccaacataactatcgccccgggtacttcacccagacggccggaccttggcacctcggcaaactggagcttgattttgacctgtgcgaagggaccacagtcgtggttgatgagcactgcggaaatcggggcccctccctcagaaccacaaccgtgacgggcaagattatccatgaatggtgttgccggagctgtacactgcctcccctgcgcttcaaaggggaggacggatgctggtacggcatggagatcagaccggtcaaggaaaaggaggaaaaccttgtgaaatctatggtttccgctgggagcggagaggtggactccttttctctcggcctgctgtgtattagcatcatgattgaagaggtcatgcggtccagatggtctcgcaagatgctcatgaccgggacactggtggtgttccttctgctcaccctgggacagctgacctggaatgatcttatccggctgtgcattatggtcggcgccaacgcgagcgacaatatgggcatggggacaacgtatctcgctctgatggccacctttagaatgcgccctatgttcgccgttggactcctgtttagacggcttacatcccgcgaggtgctgctcctgaccgtgggcctgtctcttgtcgctagcgtggaactgcccaactccctcgaggaactgggggatggactcgccatgggcatcatgattctgaaacttctgacagacttccaaagccaccagctctgggcgaccctgctgtctcttacgtttgttaagacaaccctgtccctccattacgcttggaaaaccatggccatgatcctgagcatcgtgtctctcctgcccctttgtctgtccacaaccagccagaagacaacgtggctgcctgtcctcctggggtctcttggatgcaagccgctgaccatgttcctcattacagagaacaaaatctggggcagaaagtcctggcccctgaatgaaggcattatggccgtggggatcgttagcattctcctgtccagccttctgaaaaacgatgtgcctctggctggacccctcatcgccggcgggatgctgatcgcttgttatgtcatttctggaagctccgccgacctttctctggagaaggcggccaaagtgagctgggaggaagaggctgaacactccggcgcctctcataatatcctcgtcgagattcaggatgacgggaccatgaagatcaaagatgaagaacgggacgatacaattaccatcctgctcaaggctacgctgcttgccatcagcggagtgtaccctatgtccattcccgccaccctgtttgtttggtatttctggcaaaagaaaaagcagcgctctggcgtgctgtgggacacacctagccctcccgaggtcgaaaaagctgtgctcgatgacggcatctaccgcattctgcagcgggggcttctgggacgctcccaggttggcgtgggggtctttcaagagggagtgttccacaccatgtggcacgtgacaagaggcgcggttctcatgtatcaggggaagcggctggaacccagctgggcctctgtcaaaaaggacctcatctcctacggaggcggctggcgcttccaggggagctggaacaccggagaggaggtccaggtgattgctgtcgaacccggcaagaatcctaaaaacgtgcaaacagcccccgggacgtttaagacctctgagggagaagttggcgccatcgctctggatttcaaaccggggacatccggaagccctattgtgaatagagagggcaagatcgtcggcctttacgggaacggagtggttaccacctccggcacatatgtgtctgccatcgcgcaggctaaagccagccaggaagggcccctgcctgagattgaggacgaagtctttcggaagagaaatctgacgatcatggatctccatcccggatccggcaagacccgccggtacctgcccgccattgtgagagaggctatcaaacgcaaacttcggacactggttctcgcccctaccagagtggtcgcgagcgaaatggctgaggccctgaaagggatgccgattcgctatcaaacaaccgccgtgaagtctgaacacacgggcaaagagatcgtggacctgatgtgccatgctacattcaccatgcggctcctttcccccgtcagagttcctaactacaatatgatcattatggatgaggcccactttaccgaccccgctagcatcgccgcgcgcggatatatttctacacgggtgggcatgggggaagccgctgccatcttcatgaccgctacacctcccggaagcgtggaggcctttcctcagtccaacgccgtcattcaggatgaagagaaggacatcccggaaagatcttggaatagcggctacgattggatcaccgacttccccgggaagacggtgtggtttgttccttccattaaatctggaaacgatatcgctaattgtctgcggaagaacggcaaacgcgtgattcagctgagcagaaagacattcgacaccgagtatcagaagacaaagaacaatgactgggattacgtcgtgaccacggacatctccgagatgggggcgaactttcgggccgatcgcgttattgaccccagacggtgcctcaagcctgtgatcctgaaagatggccccgaaagagtcattcttgctggaccgatgcctgtgaccgtcgccagcgccgctcagcgccggggcagaatcgggcgcaatcagaacaaggagggagaccagtacatctatatgggccaacccctgaataacgatgaagaccatgcccactggacagaggcgaaaatgctcctggataatattaacacccccgaggggatcattcctgctctgttcgaacccgagcgggaaaagtctgccgccatcgacggagagtacagactccgcggcgaagctcggaaaacattcgtggagcttatgagacgcggggatctgcctgtttggctgtcctataaggtggccagcgagggctttcagtactccgacagacggtggtgcttcgatggagaacgcaataaccaggtgctcgaggaaaatatggacgtcgagatttggaccaaagaaggcgagagaaagaagctgcggccgcgctggcttgacgcgagaacatattctgatcccctggccctccgggagtttaaagagttcgctgccgggagacgcagcgtttccggagacctgatcctggagatcggcaagctccctcagcaccttacccaacgggctcagaacgccctggataatctggtgatgctccataactctgaacaagggggaaaggcttacagacacgccatggaggaactgcccgacacgattgagacaatcatgcttctggcgctcattgccgtgctgaccggcggcgtcaccctgtttttcctcagcgggcgcggacttggcaagacatccatcgggctgctgtgtgtgatgtcctctagcgctctcctgtggatggccagcgttgagcctcattggattgctgcctctatcatccttgaatttttcctgatggtgctcctgattcccgagccggatcggcagagaacccctcaagacaatcagctggcctatgtcgtgatcggactcctttttatgattctgacagtcgctgcgaacgaaatgggcctgctcgagacgaccaaaaaggatctggggatcggacacgccgctgccgagaaccaccatcacgccgctatgcttgacgtggatctgcatcccgcctccgcgtggacactctacgccgttgctaccacaattatcacccctatgatgcggcacacgattgaaaataccacagccaacatcagcctgaccgctatcgccaatcaggcggccattctgatgggcctcgacaagggctggcccatctctaaaatggatattggggtgcctcttctggctctgggatgctacagccaagtcaaccccctcacactgaccgccgctgtgcttatgctggttgcccattatgctatcattggcccggggctccaggccaaggcgacgcgcgaggcccagaaaagaacagctgccggaatcatgaagaatcctaccgtggacggcatcgtcgctattgatctggaccccgtggtgtacgacgccaaattcgaaaagcagctggggcaaatcatgctccttattctgtgtacatcccagatcctgctcatgcggaccacctgggccctgtgcgagtctattacacttgcgacgggacccctgaccacactctgggaaggcagccctggcaagttttggaacaccacaatcgctgtttccatggccaatatcttccgcgggagctatctggctggagccggcctggccttttccctcatgaaatctcttgggggaggcagacgggggaccggagctcagggcgagacgctgggcgagaagtggaaacgccagctgaaccaactcagcaagtccgagttcaatacatacaaaagatctgggattatcgaggtcgatcggagcgaagccaaggagggactgaagcgcggcgaaaccaccaaacacgcggtgtccagagggacagccaaacttcggtggttcgtggagagaaacctggtcaaaccggagggaaaggttattgacctcggctgtgggcgcggaggctggtcttattactgcgctggcctgaaaaaggtgaccgaagtgaaagggtatacaaagggaggccccgggcacgaggaacctatccccatggccacgtacggatggaatctggtcaagctccatagcggcaaagatgtgtttttcattcctcccgagaagtgtgacacccttctgtgcgatatcggggaatccagccctaacccgacaattgaggagggacggaccctgagagttctcaaaatggtggaaccctggctgcgcggcaatcagttttgtatcaagatccttaacccttacatgccctctgtcgtggagacactggaacagatgcagcggaaacacggcgggatgctcgttagaaatcctctgtcccgcaacagcacccatgagatgtattgggtgtcttgcggaacgggcaatattgtctccgctgtgaacatgaccagccggatgctgctcaacagattcacaatggcccaccgcaagcccacctacgagcgggacgtggatctgggggcgggaacaagacacgtcgccgttgaaccggaggtggctaatcttgacatcattggccaacgcatcgaaaacattaagaatgagcataaatctacctggcactatgatgaagacaacccttacaagacatgggcctatcatgggtcctacgaggtgaaacccagcggatccgctagctctatggtcaatggcgtggttcggctgctcaccaagccctgggatgtgatccctatggtcacgcagatcgccatgacagacaccaccccctttggccagcaaagagtgttcaaagagaaggttgacacacgcacgcctaaggctaaaagagggaccgcccagattatggaagtgacagcgaagtggctgtggggatttcttagccggaacaaaaagccgcgcatctgtaccagagaggagttcacacggaaagtcagatccaatgccgctattggcgccgtgtttgttgatgagaaccagtggaactctgctaaggaagccgtggaggacgagcggttctgggatctggtccgcagagaacgggagctccacaagcaggggaaatgcgcgacctgcgtgtataacatgatgggaaagcgcgagaaaaagctgggcgagtttgggaaagcgaagggcagcagagctatctggtacatgtggctgggagcccggttcctcgaatttgaggccctgggcttcatgaatgaggaccattggttctcccgcgaaaactctcttagcggggtcgagggagaaggcctgcacaaactcgggtacattctgagagatatctccaagatccccggaggcaatatgtatgctgacgatacagccgggtgggacacccggattacggaggatgaccttcaaaacgaggctaagatcaccgatattatggaacctgagcacgccctgctcgcgacatctatctttaaactgacctaccagaataaggtggttcgcgtgcagagacccgccaaaaacggcacagtcatggacgtgattagccggcgcgatcagagaggatccggccaagtggggacctatggactgaacacgttcacaaatatggaagctcagctcatccggcagatggagagcgaaggcatcttttctccttccgagctggagacccccaaccttgccgggcgcgttctggactggctcgaaaagcatggaacagagagactgcggagaatggctattagcggcgacgattgtgtggtcaaaccgatcgacgatcgcttcgccaccgcgcttacggccctgaatgacatggggaagattcggaaggatatccctcagtgggaaccctctaaaggctggaacgactggcaacaggtgcctttttgctcccaccatttccaccagctcattatgaaggatggaagagagatcgttgtgccctgtcgcaatcaggacgaactggtcggccgggctagagtgagccaaggggccggatggtccctgcgcgagaccgcttgcctcggcaaatcttacgcccagatgtggcagctgatgtattttcaccggagagatcttcgcctggctgccaacgcgatttgtagcgccgtccctgtggactgggttcccacatcccggaccacatggagcatccatgctcaccatcaatggatgaccacagaggatatgctctctgtgtggaatagagtctggatcgaagagaacccgtggatggaagacaagacccacgtgtccagctgggaggacgttccttacctggggaaacgcgaagatcagtggtgcggatctcttattggcctgacggcccgggccacatgggctaccaatatccaggtggccattaaccaggtcagacggctcatcgggaatgagaactatctggactacatgaccagcatgaagagattcaagaatgagtccgatcccgaaggcgcgctgtggtga

SEQ ID NO: 18450 - RNA, 9879 nt, synthetic construct
  misc_feature 1..9879: note = derived and/or modified CDS sequence (opt5) from DENV-1__AB189121__SS-prME
  source 1..9879: mol_type = other RNA
agcgtgaccatgctgttcatgctcctgcccacagcccttgcttttcacctgacgaccagaggcggggaacctcatatgatcgtctccaagcaggaacggggaaaatctctcctgttcaagaccagcgccggcgttaatatgtgcacccttattgcgatggacctgggggaactctgtgaagatacaatgacctacaaatgcccgcgcatcacagagaccgaacccgacgatgtggactgttggtgcaatgctacggagacctgggtgacatatggaacctgttcccaaacaggcgagcacagacgggataagcgctctgtcgccctggcccctcatgtggggctgggactcgaaaccagaacggagacatggatgagctccgaaggcgcttggcggcagattcagaaagttgagacctgggccctgcgccaccccggctttacagtgatggctcttttcctggcccatgcgatcgggacctctattacccagaagggaatcatctttattctcctgatgcttgtcacacctagcatggccatgagatgcgtgggcatcgggaaccgggacttcgttgagggactgtccggcgctacgtgggtggatgtcgtgctcgaacacgggagctgtgtgaccacaatggccaaggacaaacccaccctggatattgagctgctcaagacagaagtcaccaatcctgctgttctgcgcaaactttgcatcgaggccaagatttctaacacgacaaccgactccagatgtccgacccaaggagaagcgacactggtggaggagcaggataccaattttgtgtgccggcgcacattcgtcgacagaggctggggcaacgggtgtggactctttggcaaagggagcctgatcacgtgcgccaagttcaagtgcgtgaccaaacttgaaggaaagattgttcagtacgagaatctgaaatattctgtgatcgtcacagtgcacaccggcgatcagcatcaagttgggaacgaaacaaccgagcacggaacgaccgctatcattacaccccaggcccctacctccgaaatccagctcacagactacggcgctctgaccctggactgtagcccccggacgggcctcgattttaatgagatggtgctgcttacaatgaaggagaaatcttggctggtccataagcagtggttcctcgacctgcctcttccctggacctccggggccagcacatcccaagaaacctggaaccgccaggatctgctcgtgacctttaaaacagcccacgctaagaagcaggaggtcgtggttctgggatctcaagaaggcgcgatgcacacggccctgaccggggctacagagattcagaccagcggaacaaccacgatcttcgccggccatctcaaatgcagactgaagatggacaaacttacactgaagggggtgtcctatgtcatgtgtaccggcagcttcaaactcgaaaaggaggtggccgagacccagcacggaacagttctggtgcaggtcaagtacgaaggcaccgatgctccgtgcaaaattcctttttcttcccaagacgagaagggggtgatccagaatggacggctgatcacagccaaccccattgtgacggataaagaaaagcctgttaatatcgaggcggagccgcccttcggcgaaagctatattgtcgtgggggctggagagaaagcccttaagctctcttggtttaagaaaggcagctccatcgggaagatgttcgaagccaccgctagaggcgcccgccggatggctattctgggagacacagcctgggattttggctctatcgggggagtgttcaccagcgtcggcaaactggtgcatcagatctttgggacagcgtacggagttctcttctccggcgtgagctggaccatgaagattgggatcggcattctgcttacgtggctgggactcaactctagatccaccagcctgtctatgacatgtatcgccgtcggcatggtgaccctgtaccttggggttatggtgcaggctgactccggatgcgtcattaattggaaaggccgcgagctcaagtgtgggagcggaatctttgtgacaaacgaagttcacacctggacagagcaatataagttccaggccgattcccctaaacggctgtctgctgccattggcaaggcgtgggaggaaggggtgtgcggcatcagaagcgccacccgcctggagaacatcatgtggaaacagatttccaatgaactcaaccatatcctgcttgagaatgacatgaagtttacggtcgtggtgggagacgtctctggcattctggctcaggggaaaaagatgatccggccgcaacccatggaacacaaatacagctggaagtcctggggaaaggccaaaattatcggcgctgatgttcagaacatcacattcattatcgacgggcctaataccagcgagtgtcccgataaccagagagcctggaatatttgggaggtggaagactatggatttggcatcttcaccacaaacatttggctcaagctgcgcgattcttacacccaggtgtgcgaccaccggctgatgtccgccgctatcaaagatagcaaggcggtccatgccgacatgggctattggatcgagtctgagaagaatgagacgtggaaacttgctagagcctccttcattgaagtgaagacatgtatctggcctaaaagccacaccctctggtctaacggggttctggagagcgagatgattatccccaagatttacggaggcccggtgtcccaacataattatcgccctgggtactttacacagaccgccggaccctggcacctgggcaaactcgaactggatttcgacctttgcgaggggacaaccgtcgtggttgatgaaaactgcggaaatcggggccctagcctgagaacgaccacagtgaccggcaagacaatccacgagtggtgttgccggtcttgtaccctgccccctctgcgctttaaaggggaggacggatgctggtacggcatggaaatcagacccgtcaaggagaaggaagagaacctggtgaaatccatggttagcgctgggtccggagaagtggattctttcagccttggcctcctgtgtatttccatcatgattgaggaggtcatgcggtctagatggagccgcaagatgctgatgacggggacactcgccgtgtttctgcttctgaccatgggacagctcacatggaatgacctgatccggctgtgcattatggtgggcgcgaacgcttccgacatgatgggcatggggaccacctatcttgccctgatggccacattcagaatgcgcccgatgtttgctgtcggactcctgttcagacggctcacgtctcgcgaagttctgcttctgaccgtgggcctcagcctggtggcctccgtcgagctgcctaacagccttgaagaactcggggatggactcgcgatgggcatcatgatgctgaaactcctgacagactttcaaccccatcagctttgggctaccctgctctctctgacattcgtgaagaccacgttttccctgcactacgcctggaaaacaatggccatgattcttagcatcgtttctctgctccccctgtgtctctccaccaccagccagaagacaacctggctgcctgtgcttctggggtctctgggatgcaagccgctcacaatgctgcttatcacggaaaataaaatttggggcagacggtcctggcccctgaacgagggcatcatggctattgggatcgtcagcattctcctgtccagcctcctgaagaatgatgtgcctcttgccggacccctgatcgctggcgggatgctgatcgcctgttatgttatttctggaagctccgcggacctctctctggagaaagccgctgaagtgagctgggaggatgaagccgagcattccggcgcttctcacaacatccttgtcgaagtgcaggacgatgggaccatgaagattaaagacgaggagcgcgatgacacactgaccatcctcctgaaggccacactcctggccattagcggagtctaccctatgtccatccccgctacccttttcgtgtggtatttttggcagaagaagaagcagagatctggcgttctgtgggatacgcctagccctcccgaagtggagcgggcggtcctggacaatggcatctaccgcattctccagagagggctgcttggacggtcccaggtgggcgttggggtgttccaagaaggagtcttccataccatgtggcacgtgacacgcggcgccgtgctgatgtatcaggggaaaagactcgagcccagctgggcttctgttaagcgggatctgatctcctacggaggcggctggagatttcaggggagctggaacaccggagaggaagtccaggtgattgccgtggagcccggcaaaaatcctaagaacgtccaaacaacccccgggacattcaaaacgccggaaggagaggtgggcgccatcgctctcgactttaagcctgggacctctggatcccccattgttaatcgcgaaggcaagatcgtgggcctgtacgggaacggagtcgtgacaaccagcggcacctatgtttccgccattgcgcaggctaaagcctctcaggaggggcctcttcccgagatcgaagacgaggtgttccggaagagaaatctgacaatcatggatctgcaccccggaagcggcaaaacgcgccggtacctccctgccattgtcagagaagctatcaagcgcaaactgcggacccttgtgctggccccgacaagagttgtggcgtccgagatggctgaagccctcaaggggatgcccattcgctatcaaaccacagccgtcaagagcgagcataccggcaaagagatcgtggacctgatgtgccacgctacgtttacaatgcggctgctctctcctgtgagagtccccaactacaatatgattatcatggatgaagcccatttcaccgaccctgcttccatcgccgcgcggggatatattagcacccgcgttggcatgggggaggccgctgccatctttatgacagctacaccccctggatctgtggaagccttcccgcagagcaacgccgtgattcaggatgaggaaagagacatccccgagcggtcctggaactctggctacgagtggattacagattttcctgggaagaccgtctggttcgtgcccagcatcaaatccggaaacgacatcgctaactgtcttcgcaagaatggcaaaagagttgtgcagctgtctcggaagacgtttgatacagaatatcaaaagaccaaaaacaatgactgggattacgtcgtgacaaccgacattagcgagatgggggcgaacttcagagccgaccgcgttatcgatcctcggagatgcctgaagcccgtgattctcaaagacggcccggaacgcgtcatcctggctggacctatgcccgtgacggtcgcctccgccgctcagcggagaggccgcattgggcggaatcccaacaaggagggagatcagtacgtgtatatgggccagcctcttaataacgacgaggatcacgcccattggaccgaagcgaaaatgctgctcgacaatatcaacacacccgaggggattatccctgctctgttcgaaccggagagagaaaagagcgccgccatcgatggagagtaccgcctgagaggcgaggctcggaagacctttgttgaactcatgcgcagaggggaccttcccgtgtggctgtcttataaagtggcctccgagggcttccaatacagcgatcggcgctggtgctttgacggagaaagaaataaccaggtcctggaggaaaatatggatgttgagatttggacaaaggagggcgaacggaaaaagctcagacctcgctggctggacgcgcggacctattccgatccccttgccctgagagagttcaaagaatttgctgccgggcgccggtctgtgagcggagacctcatcctggagattggcaagctgcctcagcacctcacacagaaagctcaaaacgcccttgacaatctggtgatgctgcacaactccgaacaagggggaaaggcttacagacatgccatggaggagctccccgataccatcgaaacgctgatgcttctggcgctcattgccgtcctgacaggcggcgtgaccctgttctttctctctgggcggggacttggcaagaccagcatcgggctgctgtgtgttatggcttccagcgccctcctgtggatggcttctgtggagccgcactggatcgccgcctccattatccttgagttctttctgatggtcctcctgattcctgagcccgaccgccagagaacacctcaggataaccagctggcttatgtggtcatcggactccttttcatgattctgaccgtggcggccaatgagatgggcctgctcgaaacaacgaaaaaggacctggggatcggacatgctgccgccgagaaccaccaccatgctgccatgcttgatgttgacctgcaccccgcgagcgcctggaccctctacgctgtggccacaaccatcattacacctatgatgcggcataccatcgaaaatacgaccgctaacatttctctgacagccatcgcgaatcaggccgctattctgatgggcctcgataaaggctggcccatctccaagatggacattggggtcccgcttctggccctgggatgctacagccaggtgaaccctctcaccctgacagctgccgttcttatgctggtggctcactatgccatcatcggccccgggctccaagcgaaagccacccgcgaggctcagaagagaacggccgctggaattatgaagaatcccacagtcgatggcatcgtggccattgacctggatcctgtggtttacgacgccaaatttgaaaagcagctggggcagatcatgctccttattctgtgtacctctcaaatcctgctcatgcggacaacctgggcgctgtgcgagagcatcacccttgctacaggaccgctgacgaccctctgggagggctcccccggcaaattctggaacacaaccattgccgtctctatggctaatatctttcgcgggagctatctggccggagccggcctggctttctccctcatgaaaagccttgggggaggcagacgggggacaggagcccagggcgaaaccctgggcgagaaatggaagcgccagctgaaccagctctccaagtctgagttcaatatttacaaaagaagcgggatcattgaggtggatcggtccgaagcgaaggagggactgaaaagaggcgagacgacaaagcatgccgtgtctcgcgggaccgctaaacttcggtggtttgtcgaaagaaacctggttaagcctgagggaaaggtgatcgacctcggctgtgggcgcggaggctggagctattactgcgccggcctgaaaaaggtgaccgaagtcaaagggtatacaaagggaggccccgggcacgaggaacctatccccatggctacctacggatggaatctggtgaaactccactccggcaaggacgttttctttacacctccggagaaatgtgatacgcttctgtgcgacattggggagtctagccccaaccctaccatcgaagagggacggacactgagagtgctcaagatggtcgaaccctggctgcgcggcaatcaattctgtattaagatccttaacccttacatgccctccgtggttgagaccctggagaaaatgcagcggaagcatggcgggatgctcgtgagaaatccgctgagccgcaactctacacacgaaatgtattgggtctcctgcggaaccggcaacattgtgagcgccgtgaatatgacgtctcggatgctgctcaacagatttaccatggcgcatcgcaaacctacatacgagcgggatgtcgacctgggggccggaaccagacacgttgctgtggaacccgaggtggccaatcttgatatcattggccagcgcatcgaaaacatcaagaatgagcacaaatccacatggcattatgacgaggataacccctacaagacctgggcttatcacgggagctacgaagtcaagccttctggatccgccagctccatggtgaatggcgttgtgagactgctcacaaaaccctgggacgtcattcctatggtgacccagatcgctatgacggatacaaccccgttcggccaacagcgggtttttaaggagaaagtggacacccgcacacccaaggccaaaagagggacggcgcagattatggaagtcaccgcccggtggctgtggggattccttagcagaaacaagaagcctcggatctgtacacgcgaggaatttaccagaaaagtgcggtctaatgctgccattggcgctgttttcgtggatgagaaccaatggaatagcgccaaggaggccgtcgaagacgagcgcttttgggacctggtgcatagagaacgggagctccacaaacaggggaagtgcgcgacatgcgtctataacatgatgggaaaacgcgaaaagaagctgggcgagttcgggaaagctaagggctccagagccatctggtacatgtggctgggagcccggtttctcgagttcgaagctctgggcttcatgaatgaggatcattggttttctcgcgaaaacagcctttccggggtggagggagagggcctgcacaaactcgggtacatcctgagagacatttctaagatccccggaggcaatatgtatgccgatgacaccgctgggtgggatacacggattaccgaagacgatcttcagaacgaggccaaaatcacggacattatggaacctgagcacgcgctgctcgccaccagcatcttcaagctgacataccagaacaaagttgtgcgcgtccaaagacccgctaagaatggcaccgtgatggatgtgatctcccggcgcgaccagagaggatctggccaggttgggacatatggactgaacacctttacgaatatggaagcccagctcattcggcaaatggagagcgagggcatcttctccccgagcgaactggagacacctaaccttgctgaaagagtgtttgattggctggagaagcatgggattgaacgcctcaaacggatggccatctctggagacgattgtgtcgtgaagcccattgacgacagattcgcgaccgccctgacagctcttaatgatatgggcaaagttcgcaaggacatccctcagtgggagccctccaaagggtggaacgattggcaacaggtgcctttttgcagccaccatttccaccaactgatcatgaaggacggccgggagattgtcgtgccctgtagaaatcaggatgaactcgtcggacgcgcccgggtgtctcagggcgctgggtggtccctgagagagaccgcctgcctgggaaagagctacgctcagatgtggcaactcatgtattttcaccgccgggacctgagacttgccgcgaacgccatctgttccgctgttccggtggattgggtccctacgtctcgcaccacatggagcattcatgcccaccatcagtggatgaccacagaagacatgctgtccgtgtggaatcgggtttggatcgaggaaaacccctggatggaggataaaacccacgtgagctcttgggaggacgtcccctacctcggcaagagagaagatcagtggtgcgggtccctgattggacttacagcccgggctacctgggccacgaatatccaagtggcgattaaccaggtgagacgcctgatcggcaatgagaactatctcgactacatgacaagcatgaaacggttcaagaatgaatctgaccctgagggggctctgtggtga

SEQ ID NO: 18451 - RNA, 9879 nt, synthetic construct
  misc_feature 1..9879: note = derived and/or modified CDS sequence (opt5) from DENV-1__AB195673__SS-prME
  source 1..9879: mol_type = other RNA
agcgtgaccatgctgctcatgctgcttcccacagctctgacgttccacctcaccacacggggaggggagcctcatatgatcgtcggaaagcaggaacggggaaaatccctgctttttaagacctctgctggggttaacatgtgcacactgattgccatggacctcggagagctgtgtgatgacaccatgacatacaaatgcccgcgcatcaccgaaacggagcccgatgacgtggattgttggtgcaatgcgaccgaaacatgggtgacctatggcacatgtagccaaaccggggagcaccggcgggacaagcgctccgtcgctctggcccctcatgtgggactcggcctggagacgagaacagaaacctggatgtctagcgagggcgcctggcggcagattcagaaagttgaaacatgggcccttcgccaccccgggttcaccgtgatcgccctgtttctcgctcatgtcattggaacctccatcacacagaagggcatcattttcatcctgcttatgctggtgacgccttctatggccatgagatgcgttgggattggaaaccgggattttgtggagggcctcagcggggcgacctgggtcgacgtggtgctggagcacggatcctgtgtcacaaccatggccaaggataaacccacactggacatcgaactcctgaagaccgaggttacgaatcctgctgtgcttcgcaaactgtgcattgaagccaagatcagcaacacaaccaccgattctagatgtccgacacaaggcgaggctaccctcgtggaagaacaggacacaaatttcgtctgccggcgcacgtttgtggatagaggctgggggaacggatgtggcctgttcgggaaaggatcccttattacctgcgccaagtttaagtgcgttacaaaactggagggcaagatcgtgcagtacgaaaatctcaaatatagcgtcatcgtgaccgttcacacaggggaccagcatcaagtgggaaacgagaccacggaacacggcaccattgcgacaatcacaccccaggcccctacatctgagattcagctgaccgactacggcgctctgacgctcgattgtagcccccggacagggctggacttcaatgaaatggtccttctgaccatgaaggagaaaagctggctcgtgcataagcagtggtttctggatcttcctctgccctggacatctggagcctccaccagccaagagacctggaaccgccaggacctcctggtcacattcaaaacggctcacgccaagaagcaggaagtggttgtgctgggctcccaagagggggccatgcacaccgctctcacaggagcgaccgaaatccagacatctggcaccacgacaatttttgccgggcatctgaaatgcagacttaagatggataaactgaccctcaagggcatcagctatgtcatgtgtaccggatccttcaaactggagaaggaagtggctgagacacagcacggcaccgttctggtgcaggtcaagtacgaggggacagacgccccgtgcaaaatccctttcagctctcaagatgaaaagggagtgacgcagaatggccggcttgtgaccgccaaccccattgttacagacaaagagaagcctgtcaatatcgaagctgagccgccctttggggagtcctatattgtggtgggagccggcgaaaaagcgctcaagctgagctggttcaagaaagggtctagcatcggcaagatgtttgaggctaccgccagaggagcccgccggatggctattctgggcgatacagcctgggacttcgggtccatcggaggcgtctttacctctgtggggaaactcgttcatcagatcttcggaacggcttacggcgtgctgtttagcggggtctcctggaccatgaagattggcatcggcattcttctgacatggctcggcctgaacagcagatctacctccctgagcatgacatgtatcgccgtggggcttattaccctctacctgggagttatggtgcaggcggattctggctgcgtcatcaattggaaagggcgcgaactgaagtgtggatccggcattttcgtgacaaacgaggttcacacctggacggaacaatataagtttcaggccgacagccctaaacggctctccgctgccatcgggaaggcttgggaggagggcgtgtgcggaatcagatctgccacacgcctggaaaacattatgtggaaacagatcagcaatgagcttaaccatattctgctcgaaaatgacatgaagttcaccgtcgtggtgggcgatgtctccgggatcctggcgcagggcaagaagtctattcggccgcaacccatggagcacaaatacagctggaagtcctggggcaaggccaaaatcatcggggctgacgttcagaacaccacatttattatcgatggacctaatacccccgaatgtcctgacgatcagagagcctggaacatttgggaggtggaggactatggcttcggcatctttacgacaaatatttggctgaaacttcgcgatagctacacccaggtgtgcgaccaccggctcatgtctgctgccatcaaagattccaaggccgtccatgctgacatggggtattggatcgaaagcgagaaaaacgaaacatggaagctggcgagagcctctttcattgaggtgaagacctgtatctggcccaaatcccacacactgtggagcaatggagttctcgaatctgagatgattatcccgaagatttacggcgggcctatcagccaacataactatcgccccggatacttcacccagacggctggcccttggcacctggggaaacttgagctggattttgacctctgcgaaggaaccacagtggtcgtggatgagcactgcggcaatcggggcccctccctgagaaccacaaccgttacggggaagatcattcatgaatggtgttgccggagctgtacactgcctccccttcgcttcaaaggagaggacggctgctggtacgggatggagatcagaccggtgaaggaaaaggaggaaaacctcgtcaaatctatggtgtccgccggaagcggcgaggttgactccttttctctggggctgctctgtattagcatcatgattgaagaggtgatgcggtccagatggtctcgcaagatgctgatgaccggaacacttgccgtcttcctgctcctgaccatgggccagctgacctggaatgatcttatccggctgtgcattatggtgggcgctaacgccagcgacaatatggggatgggaacaacgtatctcgcgctgatggctacctttagaatgcgccctatgttcgccgtgggcctcctgtttagacggcttacatcccgcgaggtcctgctcctgaccgttgggctgtctcttgtggccagcgtggaactgcccaactccctcgaggaactgggagatggcctcgctatggggatcatgatcctgaaacttctgacagacttccaaagccaccagctctgggccaccctgctgtctcttacgtttgtcaagacaaccttctccctgcattacgcgtggaaaaccatggctatgattctcagcatcgtgtctctgtttcccctctgtctgtccacaaccagccagaagacaacgtggcttcctgttctgctgggatctctcggctgcaagccgctgaccatgttccttattacagagaacaaaatctggggcagaaagtcctggcccctgaatgaagggattatggccgtgggaatcgtcagcatcctcctgtccagcctcctgaaaaacgatgtgcctcttgccggccccctgattgctgggggaatgctgatcgcctgttatgttatttctggcagctccgctgacctctctctggagaaggccgcggaggtgagctgggaagaggaagccgagcactccggggcttctcataatatccttgtcgaaattcaggatgacggaaccatgaaaatcaaggatgaggagcgggacgatacaatcaccattctgctcaaagccacgctgctcgctatcagcggcgtgtaccctatgtccattcccgccaccctgtttgtctggtatttctggcaaaagaagaaacagcgctctggcgtgctttgggacacaccttcccctcccgaagttgagagagccgtgctggatgacgggatctaccggattctgcagcgcggactcctgggcagatcccaggtcggggtgggagttttccaagaaggcgtgtttcacaccatgtggcacgtcacaagaggggctgtgcttatgtatcagggaaagcgcctggagcccagctgggcgtctgtgaaaaaggacctcatctcctacggcggcgggtggagattccagggaagctggaacaccggcgaggaagttcaggtcattgccgtggagcccgggaaaaatcctaagaacgtgcaaacagctcccggaacgtttaagacctctgaaggcgaggtcggggccatcgccctggatttcaaaccgggaacatccggcagccctatcgtgaatcgggaaggcaagattgttgggctctacggaaacggcgtggtcaccacctccgggacatatgtgtctgctatcgcccaggcgaaagctagccaggagggacccctgcctgagattgaagacgaggtttttagaaagcgcaatcttacgatcatggatctgcatcccggctccgggaaaacccggagatacctgcccgccattgtgcgcgaagccatcaagcggaagctcagaacactggtccttgctcctacccgcgtggttgccagcgagatggcggaagctctgaaaggcatgccgatccggtatcaaacaaccgccgtgaagtctgagcacacgggaagagagattgtcgacctcatgtgccatgccacattcaccatgcgcctgctgtcccccgtgcgggtgcctaactacaatatgatcattatggatgaagctcactttaccgaccccgccagcatcgctgccagaggctatatttctacacgggtcgggatgggagaggcggccgctatcttcatgaccgccacacctcccggcagcgttgaggcttttcctcagtccaacgccgtgatccaggatgaggaaaaagacattccggagcgctcttggaatagcgggtacgattggatcaccgacttccccggaaagacggtgtggtttgtcccttccattaaatctggcaacgatatcgccaattgtctcagaaagaacgggaagcgggtgattcagcttagccgcaaaacattcgacaccgagtatcaaaagaccaaaaataatgactgggattacgttgtgaccacggacatctccgaaatgggcgctaacttcagagcggatcgggtcattgaccccagacgctgcctgaagcctgtgatcctgaaagatggacccgagcgggttatcctcgccggcccgatgcctgtgaccgtcgctagcgccgcccagagacgcgggcggattggaagaaatcagaacaaggaaggcgaccagtacatctatatggggcaacccctgaataacgatgaggaccatgctcactggacagaggccaagatgcttctggataatattaacacccccgaaggaatcattcctgcgctctttgagcccgaacgcgagaaatctgctgccatcgacggcgaataccggctgagaggggaggcccgcaagacattcgtggagctgatgagacggggcgatctccctgtctggctttcctataaagtggctagcgaaggatttcagtactccgaccgcagatggtgcttcgatggcgagcggaataaccaggttctggaagagaatatggacgtggaaatctggaccaaggagggggagcgcaaaaagctgagaccgcggtggctcgacgccagaacatattctgatcccctggcgcttcgcgaatttaaagagttcgccgctggacggagaagcgtgtccggcgacctgattctcgaaatcgggaagctgcctcagcacctgacccaacgcgcccagaacgctctcgataatcttgtcatgctgcataactctgagcagggaggcaaggcctaccggcacgctatggaggaactgcccgacacgattgagacactcatgctgcttgccctgatcgcggttctcaccggcggggtgaccctgtttttcctgagcggaagaggcctcgggaaaacatccattggacttctgtgtgtgatgtcctctagcgccctgctctggatggctagcgtcgaacctcattggatcgccgcttctatcattctggagtttttccttatggtgctgctcatccccgaaccggatcggcagcgcacccctcaagacaatcagctggcctatgttgtgattggcctgctctttatgatccttacagtcgccgctaacgagatggggctgctggagacgaccaagaaagatctcggaattggccacgcggccgctgaaaaccaccatcacgccgccatgctggacgtggatcttcatcccgcttccgcctggacactgtacgcggtcgccaccacaatcattacccctatgatgagacacacgatcgagaataccacagctaacatcagcctcaccgccattgctaatcaggccgcgatcctgatgggcctggacaaggggtggcccatttctaaaatggatatcggagtgcctctccttgccctgggctgctacagccaagttaaccccctgacactcaccgctgccgtgctgatgcttgtcgctcattatgccattatcgggccgggactgcaggctaaggccacgcgggaagcgcagaagcgcacagccgctggcatcatgaaaaatcctaccgtggacgggattgttgccatcgatctcgaccccgtggtctacgacgctaagttcgagaaacagctgggacaaattatgctgctcatcctttgtacatcccagattctgctgatgagaaccacctgggccctctgcgaatctatcacactggccacgggcccccttaccacactgtgggagggcagccctgggaagttttggaacaccacaatcgcggtgtccatggctaatattttccggggaagctatctcgccggcgctgggctggccttctccctgatgaaatctctcggaggcgggcgcagaggaaccggcgcccagggcgagacgcttggggaaaagtggaagcggcagctgaaccaactgagcaaatccgagtttaatatctacaagcgctctggaattgtggaagttgatagaagcgaggctaaagaaggcctcaagagaggggaaacaatcaaacacgccgtctccagaggaaccgcgaagctgcgctggttcgtggagcggaaccttgtgaagccggaaggcaaagtcattgacctggggtgtggaagaggcggctggtcttattactgcgccgggctcaagaaagttaccgaggtgaagggatatacaaaaggcgggcccggacacgaggagcctatccccatggctacctacggctggaatctggtgaagctgtacagcgggaaagatgtctttttcattcctcccgaaaagtgtgacacactcctttgcgatatcggagagtccagccctaacccgacgatcgaggaaggccgcaccctgcgggtgctgaagatggttgagccctggctcagaggcaatcagttttgtattaaaatcctgaacccttatatgccctctgtggtcgaaacacttgagcagatgcagcgcaagcatgggggaatgctggtgcggaatcctctctccagaaacagcacccacgagatgtactgggtttcttgcggcacagggaatattgtgtccgccgtcaacatgaccagccgcatgctgctgaaccggttcacgatggctcatagaaaacccacctatgaacgcgacgtggatctcggagccggcacacggcacgtggcggtcgagccggaagttgccaatctggacatcattgggcaaagaatcgagaacatcaagaatgaacacaaatctacctggcattacgatgaggacaacccttataagacatgggcttaccacggatcctatgaggtgaagcccagcggctccgccagctctatggtgaatggcgtcgtgcgccttctgaccaaaccctgggatgttattcctatggtgacacagatcgctatgaccgacacgacaccctttgggcagcaaagagtcttcaaggaaaaagtggacacccggacccctaaggccaaacgcggaacagctcagattatggaggttacggccaagtggctctggggctttctgagcagaaacaagaaaccgcggatctgtaccagagaagagttcacacggaaggtgcgctccaatgcggccattggggctgtctttgtggatgaaaaccagtggaactctgccaaagaggctgttgaggacgaaagattctgggatcttgtgcggcgcgagagagaactgcataagcagggaaaatgcgctacctgcgtctacaacatgatgggcaagcgggagaagaaactcggggaatttggcaaggccaaaggaagccgcgcgatctggtacatgtggctgggcgctagattcctggagttcgaggccctcgggtttatgaatgaagaccactggttctcccgggagaactctctgagcggagtggaaggcgaggggcttcataagctgggatatatcctccgcgatatttccaaaatccccggcgggaatatgtacgccgacgatacagctggctgggacaccagaattacagaggatgacctgcaaaacgaagccaagatcaccgatattatggagcctgaacacgcccttctggccacgtctatctttaaactcacctatcagaataaggtcgtgcgggttcagcgccccgcgaagaacggaacagtgatggacgtcatcagcagacgggatcagcgcggctccgggcaagtgggaacctacggcctgaacacattcaccaatatgggggcccagctgattagacagatggagagcgaaggaatcttttctccttccgagctcgagacgcccaacctggctggccgggtgcttgactggctggaaaaacacgggattgagagactccgccggatggccatcagcggcgacgattgtgttgtgaagccgattgacgatagattcgctacagccctgaccgcgcttaatgacatgggaaaagtccgcaaggatatccctcagtgggaaccctctaaaggctggaacgactggcaacaggtgcctttttgctcccatcacttccatcagctgattatgaaggatgggcgggagatcgttgtgccctgtagaaatcaggacgaactcgtcggacgcgcccgggtgagccaaggcgctgggtggtccctgagagagacagcctgcctgggaaagtcttatgctcagatgtggcagctcatgtactttcaccgccgggatctgagacttgccgctaacgccatctgtagcgcggtccctgtggactgggttcccacctcccgcacgacctggagcattcacgcccatcaccaatggatgacaaccgaggatatgctgtctgtgtggaatcgggtctggatcgaagagaacccgtggatggaagacaaaacacatgtgtccagctgggaggacgttccttatctcggcaagagagaagatcagtggtgcgggtctctgattggccttaccgctcgggccacatgggccaccaatatccaggtggctattaaccaggtcagacgcctgatcggaaatgagaactacctcgactacatgacgagcatgaaacggttcaagaatgagtccgatcccgaaggcgccctgtggtga

SEQ ID NO: 18452 - RNA, 9879 nt, synthetic construct
  misc_feature 1..9879: note = derived and/or modified CDS sequence (opt5) from DENV-1__AB204803__SS-prME
  source 1..9879: mol_type = other RNA
agcgtgaccatgctgctcatgctgcttcccaccgtcctgacgttccacctcaccacaagaggcggggaacctcatatgatcgtttccaagcaggaacgggggaaatctctgctttttaagaccagcgccggcgtgaacatgtgcacactgattgctatggacctcggggaactgtgtgaagataccatgacatacaaatgcccgagaatcaccgaaacggaacccgacgatgtggactgttggtgcaatgccaccgagacatgggtcacctatggaacatgttcccagaccggcgagcacagacgggataagcgctctgtggcgctggctcctcatgttgggctcggactggaaacgagaacagagacctggatgagctccgaaggcgcctggaaacagattcagaaggtggagacatgggcccttcggcaccccggcttcaccgtcatcgctctgtttctcgcccatgctattgggacctctatcacacagaagggaatcattttcatcctgcttatgctggtgacgcctagcatggccatgcgctgcgttggcattgggaacagagactttgtggagggactctccggcgcgacctgggtcgatgtggtgctggaacacgggagctgtgtcacaaccatggccaaagacaagcccacactggatatcgagctcctgaaaaccgaagttacgaatcctgctgtgcttcggaagctgtgcattgaggccaaaatctctaacacaaccaccgactcccgctgtccgacacaaggagaagctaccctcgtggaggagcaggatacaaatttcgtctgcagacggacgtttgtggaccgcggctggggcaacgggtgtggactgttcggcaaggggagccttattacctgcgttaagtttaaatgcgtgacaaagctggaaggaaaaatcgtccagtacgagaatctcaagtattctgtgatcgttaccgtgcacacaggcgatcagcatcaagtcgggaacgaaaccacggagcacggaaccattgccacaatcacaccccaggcgcctacatccgaaattcagctgaccgactacggcgccctgacgctcgactgtagccccagaacaggcctggatttcaatgagatggtgcttctgaccatgaaagagaagtcttggctcgtccataaacagtggtttctggaccttcctctgccctggacatccggggctagcacctcccaagaaacctggaaccggcaggatctcctggtgacattcaagacggcccacgctaagaaacaggaggttgtggtcctgggatctcaagaaggcgccatgcacaccgccctcacaggggctaccgagatccagacaagcggaaccacgacaatttttgcgggccatctgaagtgccgccttaaaatggacaagctgaccctcaaagggacctcctatgtgatgtgtacaggcccgttcaagctggaaaaggaggttgccgagacccagcacggaacagtgctggtccaggtgaaatacgaaggcacggatgctccttgcaagatccccttcagctctcaagacgagaaaggggtgacccagaatggaagacttatcacagccaaccctattgttaccgataaggaaaaacccatcaatattgaggccgagcccccttttggcgaatcctatatcgtcgtgggggtgggagagaaggctctcaagctgagctggttcaaaaagggctctagcattgggaaaatgtttgaagccacagcgcggggcgctagacgcatggccatcctgggagacaccgcctgggatttcggctccatcgggggagtctttacgtctatgggcaagctcgtgcatcagattttcgggaccgcttacggagttctgtttagcggcgtgtcctggacaatgaaaatcgggattggcatccttctgacctggctcggactgaacagccggtctacatccctgagcatgacctgtattgccgtcggcatggtgacactttacctcggggttatggtgcaggctgactctggatgcgtcatcaattggaagggcagagagctgaagtgtgggtccggaattttcgtgaccaacgaagttcacacgtggacagagcaatataaatttcaggccgatagcccgaagcgcctgtccgcggccatcggcaaggcttgggaggaaggggtgtgcggcatccggtctgccaccagactcgagaacattatgtggaagcagatcagcaatgaactgaaccatattcttctggagaatgacatgaaattcaccgtcgtggtgggagacgtctccggcatcctcgctcaggggaagaaaatgattcgcccccaacctatggaacacaagtactcttggaaaagctggggaaaagccaagatcatcggcgcggatgttcagaacacaacctttattatcgacgggcccaatacgcctgagtgttccgatgaccagcgggcctggaacatttgggaggtggaagattatggattcggcatctttacaaccaatatttggctgaaactgagagacagctacacacaggtgtgcgatcaccgccttatgtctgctgccatcaaggactcccgggctgtccatgccgatatgggctattggatcgagagcgagaaaaatgagacctggaagctcgccagagcttctttcattgaagtgaagacatgtatctggcccaaatcccacaccctgtggagcaatggggttctggagtctgagatgattatcccgaagatttacggaggccctatcagccaacataactatcgccccgggtacttcacgcagaccgcgggaccttggcacctcggcaaactggaacttgactttgatctgtgcgaggggacaaccgtggtcgtggacgaacagtgcggaaatcggggcccctccctcagaacaaccacggttacaggcaagatcattcacgagtggtgttgccggagctgtaccctgcctcccctgcgcttcaaaggggaggatggatgctggtacggcatggaaatcagaccggtgaaggagaaggaagagaaccttgtcaaatctatggtgtccgccgggagcggagaagttgactccttttctctcggcctgctgtgtattagcatcatgattgaggaggtgatgcggtccagatggtctcgcaagatgctcatgacagggaccctggctgtcttccttctgctcaccatgggacaactgacatggaatgacctgatccggctttgcattatggtgggcgccaacgccagcgataaaatgggcatggggacgacctatctggctctcatggccacatttagaatgcgccctatgttcgcggtgggactgctctttagaggcctgacctcccgggaagtccttctgctcacagttgggctgtctctggtggctagcgtggagcttcccaattccctggaagaactcggagacggcctggccatggggatcatgatgctcaagctgcttaccgatttccagagccatcagctgtgggccacgctcctgtctctgacatttgtcaaaaccaccttctcccttcactacgcttggaagacaatggccatgaccctgagcatcgtgtctctctttcccctgtgtctctccacaacgagccagaagaccacatggctgcctgttcttctgggatctctgggctgcaaaccgctcaccatgttcctgattacagaaaacaagatctggggccgcaaatcctggccccttaacgaggggattatggcggtgggaatcgtcagcattctgctctccagcctgctcaagaatgacgtgcctctggctggcccccttatcgccgggggaatgctgatcgcctgttatgttatttctggcagctccgctgatctgtctctcgagaaagccgctgaagtgagctgggaggaagaggccgaacattccggggcgtctcacaacatcctggtcgaggtgcaagacgatggaaccatgaagattaaagacgaggaaagagatgacacgatcaccattcttctgaaggccacactcctggctatcagcggcgtctaccctatgtccatccccgccaccctctttgtgtggtatttctggcagaagaaaaagcagcggtctggcgttctgtgggatacaccttccccgcccgaggtggaacgcgctgtccttgacgatgggatttacagaatcctgcagcggggactgctcggccgctcccaagtgggggttggagtgttccaggagggcgtctttcataccatgtggcacgtgacaagaggggccgtgctgatgtatcagggaaaacggcttgagcctagctgggcctctgttaagaaagacctgatttcctacggcggcgggtggcgcttccagggaagctggaatacgggcgaagaggtccaagtgatcgctgtggaacccgggaagaaccctaagaatgtccagaccgcgcccggaacatttaaaacctctgagggcgaagtgggggccattgctctcgacttcaagccgggaacctccggcagccctatcgttaacagagagggcaaaattgtggggctgtacggaaatggcgtcgtgacaacgtccgggacctatgtttctgccatcgcccaggctaaggccagccaagagggacccctccctgaaatcgaggatgaagtgtttcggaaaagaaacctgacaattatggaccttcaccccggctccgggaagacccgccggtacctgcccgcgatcgtcagagaggctattaagcgcaaactgcggacactcgtgctggcccctaccagagttgtggccagcgaaatggctgaggcccttaagggcatgccgatccgctatcagacgacagcggtcaaatctgagcataccggaaaggaaattgtggatctgatgtgccacgctaccttcacaatgcggctcctgtcccccgtgagagtccctaattacaacatgatcatcatggacgaggcccattttaccgatcccgccagcattgctgcccgcggctatatctctacacgggttgggatgggagaagctgccgcgattttcatgaccgccacgcctcccggcagcgtggaggcttttcctcagtccaatgccgtgatccaggacgaagagaaagatattccggagagatcttggaacagcgggtacgactggatcacagatttccccggaaagaccgtctggtttgtgccttccatcaagtctggcaatgacattgctaactgtctgcggaaaaatgggaagcgcgttatccaactcagcagaaaaacattcgataccgaatatcagaagacgaaaaacaacgactgggactacgtggtcaccacagatatttccgagatgggcgccaatttccgggccgaccgcgtgatcgatcccagacggtgccttaagcctgttattctgaaggacggacccgaaagagtgatcctggctggcccgatgcctgtcaccgtggcgagcgccgctcagcgccgggggagaattggacgcaaccagaataaagagggcgatcaatacatctatatggggcagcccctcaacaatgacgaggatcacgcccattggacagaagccaagatgctgcttgacaacatcaatacccccgagggaattatccctgctctgtttgaacccgagcgggaaaaatctgccgcgattgatggcgagtacagactccgcggggaggctcggaagacattcgtcgaactgatgagacgcggcgacctgcctgtgtggctctcctataaagttgccagcgagggatttcagtactccgatagacggtggtgcttcgacggcgaacgcaacaatcaggtgcttgaggaaaacatggatgtggagatctggaccaaggagggggaacgcaaaaagctgcggccgcgctggctggacgccagaacgtattctgaccccctcgctctgcgggagtttaaggagttcgccgcgggaagacgcagcgtctccggcgatcttattctggagatcgggaaactccctcaacacctgacacagaaggcccagaccgctctggacaatctcgttatgcttcacaactctgaacagggaggcaaagcctaccggcatgctatggaggagctgcccgataccatcgaaacactgatgctcctggcccttattgctgtgctgaccggcggggtgacactctttttcctgagcggaaagggcctggggaaaacgtccatcggactcctttgtgtcatgagctctagcgccctgctgtggatggcgagcgtggagcctcactggattgccgcttctatcattctcgaatttttcctgatggttcttctgatccccgagccggacagacaacgcacccctcaggataatcagctcgcctatgtggtcatcggcctgctgtttatgattctcacagtggctgccaacgagatggggcttctggaaaccacaaagaaggacctgggaatcggccatgccgctgcggagaatcaccaccatgccgctatgctcgatgtcgacctgcaccccgcctccgcctggaccctttacgctgtggccacgaccattatcacacctatgatgcggcataccattgaaaacacaaccgcgaacatcagcctgacggccattgctaatcaagccgctatcctcatgggcctggataaagggtggcccatctctaagatggacattggagttcctctgctcgcccttggctgctacagccaggtgaaccccctgacactgaccgcggccgtcctcatgctggtggctcactatgccatcattgggccgggacttcaggctaaagccacaagagaggctcagaagcggaccgccgcgggcatcatgaaaaatcctaccgttgatgggattgtggccatcgacctggatcccgtcgtgtacgacgctaagttcgaaaagcaactcggacagatcatgctgctgattctctgtacatcccagatccttctgatgcgcacgacctgggccctgtgcgagtctattacactcgctaccggccccctgacaaccctttgggagggcagccctgggaaattttggaacacgacaatcgccgtgtccatggccaatattttcagaggaagctatctggcgggcgctgggctcgccttctccctgatgaagtctctgggaggcgggcggcgcggaaccggcgctcagggcgaaaccctcggggagaaatggaagagacaacttaaccagctgagcaaatccgaatttaatacatacaagcggtctggaatcatggaggttgaccgcagcgaagccaaggagggcctgaaaagaggggagaccacaaagcatgccgtctcccggggaacggctaaactccgctggttcgtggaaagaaacctggtgaagccggagggcaaagtcatcgatcttgggtgtggacggggcggctggtcttattactgcgccgggctgaagaaagttaccgaagtgaagggatatacaaagggcgggcccggacacgaggaacctattcccatggcgacctacggctggaatctcgtgaaactgcacagcgggaaggacgtctttttcatccctcccgagaaatgtgatacactgctctgcgacattggagagtccagccctaacccgaccatcgaagagggcagaacgcttcgcgtgctgaagatggttgaaccctggctgcggggcaatcagttttgtattaaaatcctcaacccttacatgccctctgtggtcgagaccctggagcagatgcaaagaaagcatgggggaatgcttgtgcgcaatcctctgtcccggaacagcacacacgaaatgtattgggtttcttgcggcaccgggaatattgtgtccgccgtcaacatgacaagcagaatgctcctgaatcgcttcaccatggctcatcggaagcccacatacgagagagatgtggacctgggagccggcacccgccacgtggctgtcgaaccggaggttgccaacctcgatatcatcgggcagcggattgaaaacatcaaaaatgagcacaagtctacgtggcattatgacgaggataacccttacaaaacatgggcgtatcacggatcctacgaagtgagacccagcggctccgccagctctatggtgaatggcgtcgtgcgcctgcttaccaagccctgggacgttattcctatggtgacccagatcgctatgacagatacgaccccctttgggcaacagcgggtcttcaaagagaaggtggacacaagaacccctaaggccaaacgcggaacagctcagattatggaagttaccgccaagtggctgtggggctttctcagcagaaacaaaaagccgcggatctgtacacgcgaggagttcaccagaaaagtgcggtccaatgctgccatcggggcggtctttgtggacgagaaccagtggaactctgccaaggaggctgttgaagatgagagattctgggacctggtgcatcgggaacgcgagcttcacaagcaaggaaaatgcgccacgtgcgtctataacatgatgggcaagagagagaaaaagctgggggagtttggcaaagctaagggaagccgggccatttggtacatgtggctcggcgcccgcttcctggagttcgaagcgctggggtttatgaatgaggatcattggttctccagagaaaactctctcagcggagtggagggcgaggggctgcacaaacttggatacatcctgcgggacatttccaagatccccggcgggaatatgtatgctgatgacaccgccggctgggatacacgcattaccgaagacgatctccagaacgaggccaagatcacagacatcatggaacctgagcacgctctgcttgccacctctatttttaaactgacgtaccagaataaggtcgtgagagttcagcggcccgctaaaagcggaacagtgatggatgtcatctcccgcagagaccaacggggcagcggacaggtgggaacctatggcctcaacacattcaccaatatggaagcccagctgattcgccagatggagtctgaggggatcttttcccctagcgaactggagacgcccaacctcgcgggaagagtgctggattggcttgaaaagcatggcattgagcggctgaaacgcatggccatctctggggacgactgtgttgtgaagccgatcgatgacagattcgctaccgccctcacagctctgaacgatatgggcaaggtccggaaagacattcctcaatgggaaccctccaagggatggaatgattggcaacaggtgcctttttgcagccaccatttccaccagcttatcatgaaagacggcagagagattgttgtgccctgtcgctcccaagatgagctggtcgggcgggccagagtgtctcagggagcgggctggagcctccgcgaaaccgcctgcctggggaagtcctacgctcagatgtggcaactgatgtattttcaccggagagacctccgcctggccgctaacgccatctgtagcgctgtccctgtggattgggttcccacatctcggaccacatggtccattcatgcccaccatcagtggatgaccacggaggacatgcttagcgtgtggaatagagtctggatcgaagagaacccgtggatggaagataaaacacacgtgtctagctgggaggacgttccttacctgggaaagcgcgaggaccagtggtgcggctccctcattgggctgaccgcgcgggccacctgggctacaaatatccaggtggccatcaaccaagtcagacgccttattggcaatgaaaactatctggattacatgacctctatgaagcggttcaaaaatgagagcgaccccgaaggagccctctggtga

SEQ ID NO: 18453 - RNA, 9879 nt, synthetic construct
  misc_feature 1..9879: note = derived and/or modified CDS sequence (opt5) from DENV-1__LC016760__SS-prME
  source 1..9879: mol_type = other RNA
agcgtgaccatgctgctcatgctgatgcccaccgcccttgctttccacctgacgaccagaggaggggaacctcatatgatcgtctccaagcaggaacgggggaaatctctcctgtttaagaccagcgccggcgttaacatgtgcacccttatcgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagcacaaatactcttggaaaagctggggaaaggccaaaattatcggcgctgacgtgcagaataccacctttatcattgatgggcctaacacacccgaatgtcctgacgatcagagagcgtggaatatctgggaggtcgaggactatggattcggcatttttaccacgaacatctggctgaagctgcgcgattcctacacacaggtttgcgaccaccggcttatgagcgccgctattaaagattctaaggccgtgcatgccgacatgggctattggatcgaatccgagaaaaatgaaacctggaagctcgctagagccagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgcgggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgctacagaggggaggacggatgctggtatggcatggagattcggccggtgaaagaaaaggaggaaaatcttgttaagagcatggtgtctgctgggtccggagaggtcgacagcttctccctcggcctgctgtgtatctctattatgatcgaagaggtgatgagaagccgctggtcccggaaaatgctcatgacagggaccctggccgtctttttccttctgattatgggacagctcacatggaacgatctgatcagactgtgcattatggtgggcgccaatgcttctgaccgcatgggcatggggaccacctaccttgccctgatggcgacatttaagatgagacctatgttcgctgtcggactcctgtttcggcgcctcacgagcagagaggtgctgcttctgaccatcggcctctccctggtggcctctgtcgaactgcccaacagccttgaggaactgggggatggactcgccatgggcatcatgattctgaaactcctgacagacttccaatcccaccagctttgggctaccctgctcagcctgacatttatcaagaccacgttctctctgcattatgcctggaaaacaattgctatggttctttccatcgtgagcctgtttcccctctgtctgtctaccacctcccagaagacaacctggctccctgtgctgcttgggagcctgggatgcaagccgctgacaatgttcctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcacagcggcgcgtcccataatatcctcgtggaagttcaggatgacgggacgatgaaaatcaaggatgaggagcgcgacgataccctgacaattcttctgaaagccaccctcctggctgtgtctggagtctatcctctcagcatccccgccacactgtttgtgtggtacttctggcaaaagaagaaacagagatccggcgtcctttgggacaccccttctcccccggaagtggagcgggccgttctggatgacggcatttatcgcatcatgcagagagggctgctcggacggagccaggtgggcgtcggggtgttccaagaaaacgtttttcacacgatgtggcacgtgacccgcggagctgtcctgatgtaccagggcaagagacttgagccttcctgggccagcgtgaaaaaggacctgatttcttacgggggaggctggcggctccagggctcctggaatacaggggaggaagtgcaggttatcgcggtcgagcccggcaaaaaccctaagaatgtgcaaaccgctcccggcacattcaagaccccggaaggggaggtgggagccattgccctggattttaaacctggcacaagcgggtctcccatcgtcaacagagaaggaaagatcgtgggcctctatggcaatggggttgtgacgacctccggaacatacgtcagcgctattgcccaggcgaaggcttcccaggagggccctctgcccgagatcgaagacgaggtgttccgcaagcggaaccttaccattatggatctgcatcccgggtctggaaaaaccagacgctatctgcctgccatcgttcgggaagccattaagagaaagctccgcacactgatccttgctccgacgcgggtggtcgccagcgagatggctgaagccctgaaaggcatgcccatcagataccaaaccacagcggtgaagtccgagcacaccgggaaagagattgttgacctcatgtgccatgccacatttaccatgcgcctgctgagccctgtgcgggtccccaattataacatgatcattatggatgaagctcacttcacggacccttcttccatcgccgctagaggctacattagcacacgggtgggaatgggcgaggccgccgctatctttatgaccgcgacaccccctgggtctgtggaagccttcccgcagagcaatgctgtcatccaggatgaggaacgcgacattcccgagagatcctggaactctggatatgagtggatcacagattttcctggcaagaccgtttggttcgtgcccagcattaaatccgggaatgacatcgccaactgtctccggaagaatggaaagcgcgtgattcagctttctagaaaaacatttgataccgaataccaaaagacgaaaaacaacgactgggactacgtcgtgacaaccgatatcagcgagatgggcgccaatttccgggctgacagagttattgatcctcgccggtgcctgaagcccgtgatcctgaaagacgggccggaaagagtcatcctcgccggccctatgcccgtgacagttgcgtccgctgcccagcgccggggaagaattggccgcaaccataataaggagggggatcagtatatctacatgggacagcccctgaacaatgacgaggatcacgcccactggaccgaagctaagatgcttctggacaacattaatacgcctgagggcatcattcccgccctcttcgaacctgagcgggagaaaagcgcggccatcgatggggagtatagactgcgcggagaggctagaaagacctttgtggaactgatgcggcgcggcgacctcccggtctggctttcttacaaagtggcctccgaggggttccaatatagcgatagacggtggtgctttgacggcgaacgcaacaatcaggtcctggaggaaaacatggatgtggagatctggacaaaggagggagaacgcaagaaactgcggcccagatggctcgacgctcgcacctactccgaccctctggcccttcgggagttcaaagaatttgctgccggcagacgctctgttagcggggatctgattctcgagatcggaaagctgccccagcatctgacacagcgggcgcaaaatgccctcgacaaccttgtgatgctgcacaattccgaacagggcgggagagcttatcggcatgccatggaggagctgcctgataccattgaaacactcatgctgcttgctctgatcgccgtgctcaccggaggcgtcacgctgttctttctgtctggcaaggggctcggaaaaacaagcattggccttctgtgtgttatggcctccagcgtgctgctctggatggcttctgtggagccccactggatcgcggcctccatcattctggagttctttcttatggtcctgctcatcccggagcctgaccgccagagaacaccccaggataaccaactggcttacgtggttattgggctcctgttcatgatccttaccgtggccgccaatgagatgggactgctggaaacaaccaagaaagacctcggcattgggcacgtcgctgtggagaaccatcaccatgccgcgatgctggatgtcgaccttcaccctgccagcgcttggacactgtacgccgtggctacgaccatcattacacccatgatgcggcataccatcgaaaacacaaccgccaatatctctctcacggcgattgccaaccaggctgccatcctgatgggactggataagggctggcctatttccaaaatggacatcggcgttcccctccttgctctggggtgctatagccaggtgaatccgctgaccctcacagccgctgtcctgatgcttgtggcccactacgcgattatcggacctggcctgcaagccaaggctacccgcgaggcccagaagagaacagctgccgggatcatgaaaaaccccaccgttgatggaattgtggccatcgacctcgatcccgtcgtgtatgacgcgaagtttgaaaaacagctgggccagattatgctgctcatcctttgtacgtctcaaattctgctgatgcggacaacctgggctctctgcgagagcatcacactggccaccgggcctcttaccacactgtgggagggatccccgggcaagttctggaatacgaccatcgctgtgtctatggccaacatttttcgcggcagctacctcgccggggctggactggccttctccctgatgaaaagcctcggcgggggaagacggggcacaggggcgcagggagaaacccttggcgagaagtggaagcgccagctgaatcagctgtccaaatctgagttcaacacatataagagaagcggcatcatggaggttgaccggtccgaagccaaagaggggctcaagagaggagagaccacgaaacacgctgtctctcgcggcacagccaagctgcggtggtttgtggaaagaaatcttgtgaagcccgaggggaaagtcattgatctgggatgtggccgcgggggatggagctactattgcgctggcctcaagaaagttaccgaagtgaagggctacaccaaagggggacctggccatgaggaacccgtgcctatggccacatacgggtggaacctggtcaagctgcactccggaaaagacgtgttctttattccccctgagaagtgtgataccctcctttgcgacattggcgagtctagcccgaatcccacaatcgaagaggggcggacgctgagagttctgaagatggtggaaccttggctccgcggaaaccaattctgtattaaaatcctgaatccctatatgccttccgtcgtggagacccttgagcagatgcagcggaagcatggcggcatgctggttagaaaccccctcagccgcaattctacacacgaaatgtactgggtgtcctgcgggaccggaaacatcgtcagcgcgattaatatgacatctcggatgctgctgaacagatttaccatggcccaccgcaaaccgacgtatgagcgggatgtggacctcggcgctgggaccagacatgtggccgtcgaacctgaggttgctaacctggatatcattggacagcgcatcgaaaatattaagtgtgagcacaaatccacatggcattacgacgaggataacccctataagacctgggcctaccacggcagctatgaagtgaagccctctgggtccgctagctccatggtgaatggagtcgtgaaacttctgacaaagccttgggacgttatccccatggtgacccaaatcgccatgacagataccacgcctttcggccagcagagagtctttaaagagaaggtggacacacggaccccgaaagcgaagcgcggcaccgcccaaattatggaagttacagctagatggctctgggggttcctgagccggaacaagaaacccagaatctgcacgcgggaggaatttacccgcaaggtgagatctaatgccgctattggagccgtcttcgtggacgagaaccagtggaatagcgccaaagaggcggttgaagatgagcggttttgggaccttgtgcatcgcgaaagagagctgcacaagcagggcaaatgcgctacatgtgtctacaacatgatggggaagcgggaaaagaaactcggagagttcggcaaggccaaagggtcccgcgccatctggtacatgtggctgggcgctagatttctggagttcgaagccctcggattcatgaatgaggatcactggttttctcgggaaaacagcctgtccggcgtggagggggagggacttcataagctgggctatattctccgcgacatctctaaaatcagcgggggaaatatgtacgctgatgacaccgccggctgggatacaagaattaccgaagacgatctgcagaacgaggcgaagatcacagaaattatggagcctgaacacgcccaacttgctaaagccatcttcaagctgacctatcagaataaggtcgtgcgggttcagcgccccgctaaaaacgggacggtgatggacgtcatttccagacgggatcagcgcggctctggacaagtgggcacctacgggctcaatacatttaccaacatggaggcccagctgatcagacagatggagagcgaaggaatcttctcccctagcgagctggaaacacccaacctcgcggagcgggtgctggactggcttgaaaagtatggcgttgagagactgaaacgcatggccatttctggggatgactgcgtggtcaagccgatcgacgatcggtttgctaccgccctcacggctctgaatgacatgggaaaagtgagaaaggatattcctcagtgggagccctccaagggctggaacgactggcaacaggttcctttctgtagccatcactttcaccagcttatcatgaaagatgggcgcgaaattgtggtcccctgccggaatcaggacgagctggtgggcagagcccgcgtctctcaaggagctggctggtccctccgggaaacagcctgtctgggaaagagctacgcgcagatgtggcagctgatgtatttccatagacgcgatctccggctggccgctaacgccatctgctccgccgtgcctgttgactgggtgcccacctctagaacaacctggagcattcacgctcatcaccaatggatgacgaccgaggatatgctttccgtctggaatcgcgtgtggatcgaagagaacccgtggatgaaagacaagacacatatcagctcttgggaggatgttccttacctgggaaaacgggaagaccagtggtgtggctccctcattgggctgaccgccagagcgacatgggctaccaatatccaggtggccattaaccaggtccggagacttatcggaaatgagaactacctggactatatgacaagcatgaagcgctttaagaatgaatctgatcccgagggcgccctctggtga

SEQ ID NO: 18454 - RNA, 9879 nt, synthetic construct
  misc_feature 1..9879: note = derived and/or modified CDS sequence (opt5) from DENV-1__LC128301__SS-prME
  source 1..9879: mol_type = other RNA
agcgtgaccatgctgcttatgctgcttcccacagccctggctttccacctcacgacccggggcggggaacctcatatgatcgtctccaagcaggaacggggaaaatctctgctttttaagacaagcgccggcgttaatatgtgcaccctgattgcgatggacctcggggagctgtgtgaagatacaatgacctacaaatgcccccgcatcacagagaccgaacccgacgatgtggactgttggtgcaatgctacggagacctgggtgacatatggaacctgttcccaaacaggcgagcacagacgggataagcgctctgtcgccctggcccctcatgtggggctcggactggaaaccagaacggagacatggatgagctccgaaggcgcttggcggcagattcagaaagttgagacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggactttgttgagggactctccggcgctacgtgggtggatgtcgtgctggaacacgggagctgtgtgaccacaatggccaaggacaaacccaccctggatatcgagctcctgaagacagaagtcaccaatcctgctgttcttcgcaaactgtgcattgaggccaagatctctaacacgacaaccgactccagatgtccgacccaaggagaagcgacactcgtggaggagcaggataccaatttcgtgtgccggcgcacatttgtcgacagaggctggggcaacgggtgtggactgttcggcaaagggagccttattacgtgcgccaagtttaagtgcgtgaccaaactggaaggaaagatcgttcagtacgagaatctcaaatattctgtgatcgtcacagtgcacaccggcgatcagcatcaagttgggaacgaaacaaccgagcacggaacgaccgctacaattacaccccaagcccctacctccgaaatccagctgaccgactacggcgctctgacgctcgactgtagcccccggacaggcctggatttcaatgagatggtgcttctgaccatgaaggagaaatcttggctcgtccataagcagtggtttctggaccttcctctgccctggacatccggggccagcacctcccaagaaacctggaaccgccaggatctcctggtgacattcaaaacggcccacgctaagaagcaggaggtcgtggttctgggatctcaagaaggcgcgatgcacaccgccctcacaggggctaccgagattcagacaagcggaaccacgacaatctttgccggccatctgaaatgcagacttaagatggacaaactgaccctcaagggggtgtcctatgtcatgtgtaccggcagcttcaaactggaaaaggaggtggccgagacacagcacggaaccgttctggtgcaggtcaagtacgaaggcacagatgctccgtgcaaaattcctttctcttcccaagacgagaagggggtgacgcagaatggacggcttatcaccgccaaccccatcgtgacagataaagaaaagcctgttaatattgaggcggagccgccctttggcgaaagctatctcgtcgtgggggctggagagaaagccctgaagctgtcttggttcaagaaaggcagctccatcgggaagatgtttgaagccaccgctagaggcgcccgccggatggctattctcggagacacagcctgggatttcggctctatcgggggagtgtttaccagcgtcggcaaactgattcatcagatcttcgggacggcgtacggagtgctcttttccggcgttagctggaccatgaagatcgggattggcatcctgctcacatggctgggactgaactctagatccaccagcctttctatgacatgtattgccgtgggcatggtcaccctctacctgggggtgatggttcaggctgactccggatgcgtgatcaattggaaaggccgcgagctgaagtgtgggagcggaattttcgtcacaaacgaagtgcacacctggacggagcaatataagtttcaggccgattcccctaaacggctctctgctgccatcggcaaggcgtgggaggaaggggtttgcggcattagaagcgccacacgcctggagaacatcatgtggaaacagatctccaatgaacttaaccatattctgctcgagaatgacatgaagttcaccgtggtcgtgggagacgtgaacggcatcctggctcaggggaaaaagatgattcggccgcaacccatggaacacaaatactcttggaaaagctggggaaaggccaaagtcatcggcgctgatgttcagaataccacatttattatcgacgggcctaacacccccgagtgtcctgatgaccagagagcctggaatatctgggaggtggaagattatggattcggcatttttacgacaaacatctggctgaaacttcgcgactcctacacccaggtgtgcgatcaccggctcatgagcgccgctattaaagactctaaggcggtccatgccgatatgggctattggatcgagtccgagaagaatgagacatggaagctgaccagagctagcttcattgaagtgaagacatgtatctggcccaaatctcacaccctgtggtccaacggggttctcgagagcgagatgatcattccgaagacgtacggaggccctatctctcaacataattatcgccccgggtacttcacccagacagccggaccttggcacctgggcaaacttgaactggactttgggctctgcgagggaaccacagtggtcgtggatgaacactgcggcaaccggggccccagcctgagaaccacgacagttaccgggaagattatccatgagtggtgttgccggtcctgtacactgcctccccttcgcttcaaaggagaggacggctgctggtacgggatggaaattagaccggtgaaggagaaggaagagaatctcgtccggagcatggtgtctgccggatccggcgaagttgatagcttttccctggggctgctctgtatctctatcatgattgaggaggtgatgagaagccgctggtcccggaaaatgctgatgaccggaacccttgctgtcttcctgctcctgatcatgggccagctgacatggaacgaccttattagactgtgcatcatggtgggcgccaatgcgtctgacaagatggggatgggaacgacctatctcgctctgatggccacatttcgcatgagacctatgttcgccgtgggcctcctgtttcggcgccttaccagcagagaagtcctgctcctgacagttgggctgtcccttgtggcttctgtggagctgcccaacagcctcgaagaactgggagatggcctcgccatggggattatgatgctgaaacttctgaccgacttccaatcccaccagctctgggcggctctgctgagccttacgtttgtcaagacaaccttctctctgcattacgcctggaaaaccatggccatgatcctctccattatcagcctgtttcccctctgtatgtctacaacctcccagaagacaacgtggctgcctgtgcttctgggaagcctgggctgcaagccgctcaccatgttcctgatcacagaaaacaaaatttggggccggaagtcttggccccttaatgaggggatcatggctgttggaattgtgtccatcctgctcagctccctgctcaaaaacgatgtccctctggccggcccccttattgctgggggaatgctgatcgcctgttatgtgatcagcggctctagcgcggacctgtccctcgagaaggccgctgaagtttcttgggaggaagaggccgaacacagcggggcttcccataatattctggtggaggtccaggatgacggaaccatgaaaatcaaggatgaggaacgcgacgatacacttaccattctgctcaaagccacgctgctcgccatctctggcgtgtaccctatgagcattcccgctaccctgtttgtctggtatttctggcaaaagaagaaacagagatccggcgtgctttgggacacaccttctcccccggaggttgaacgggcggtgctggatgacgggatctaccgcatcctgcagagaggactcctgggcaagagccaggtcggggtgggagttttccaagagggcgtgtttcacaccatgtggcacgtcacaagaggggccgtgcttatgtatcagggaaaacgcctggagccttcctgggctagcgtgaagaaagatctcatttcttacggcggcgggtggagattccagggatcctggaacaccggcgaagaggttcaggtcatcgccgtggaacccgggaagaatcctaagaacgtgcaaacagcccccggaacgtttaaaaccccggagggcgaagtcggggctattgccctggacttcaagcctggaacaagcggctctcccatcgtgaatcgggagggcaaaattgttgggctctacggaaacggcgtggtcaccacctccgggacatatgtgagcgcgatcgctcaggccaaggcctcccaggagggacctctgcccgaaattgaggacgaagtttttagaaaacgcaatcttacgatcatggatctgcatcccggctctgggaagacccggagatacctgcctgctatcgtgcgcgaggccattaagcggaaactcagaacactggtccttgcgccgacccgcgtggttgctagcgaaatggccgaggccctgaagggcatgcccatccggtatcaaacaaccgctgtgaaatccgagcacacgggaaaggaaattgtcgacctcatgtgccatgccacattcaccatgagactgctgagccctgtgcgcgtgcccaactacaatatgatcattatggatgaggctcactttaccgaccctgcctctatcgcggcccggggctatatctccacaagagtcgggatgggagaagctgccgctattttcatgaccgccacaccccctggcagcatggaggcctttccgcagtctaacgctgcgatccaggatgaagaacgggacattcccgagcgcagctggaactccgggtacgattggatcaccgacttccctggaaaaacggtttggtttgtgccctctattaagagcggcaacgatatcgccaattgtctcagaaagaacgggaaacgggtggtccagctttcccgcaagacattcgacaccgaatatcagaagaccaagaacaatgattgggactacgtggttaccacggacatctctgagatgggcgctaacttcagagccgatcgggtgattgaccctagacgctgcctgaaacccgtcatcctgaaggatggaccggaacgggtgattctcgccggccctatgcccgttaccgtggctagcgccgcgcagagacgcgggcggatcggaagaaatcagaacaaggagggcgaccagtacatttatatggggcaacccctgaataacgatgaggaccatgctcactggacagaagccaaaatgcttctggataatatcaacacccctgagggaattatccccgccctctttgaacctgagcgcgaaaagtccgctgccatcgacggcgagtaccggctgagaggggaggcgcgcaaaacattcgtcgaactgatgagacggggcgatctcccggtgtggcttagctataaggtcgcctctgagggatttcagtactccgaccgcagatggtgcttcgatggcgaacggaataaccaggtgctggaggaaaatatggacgttgagatttggaccaaagagggggaacgcaagaaactgagaccccggtggctcgatgctagaacatatagcgaccctctggcccttcgcgagtttaaggagttcgctgccggacggagatccgtgtctggcgacctgatcctcgagattgggaagctgccccagcacctgacccaacgcgctcagaacgccctcgataatcttgtgatgctgcataacagcgaacagggaggcaaagcgtaccggcacgccatggaggagctgcctgacacgatcgaaacactcatgctgcttgctctgattgccgtcctcaccggcggggttaccctgtttttcctgtccggaagaggcctcgggaagacatctatcggacttctgtgtgtgatggctagctccgccctgctctggatggccagcgtggagccccattggatcgctgcgtctattatcctggaatttttccttatggtcctgctcattccggagcctgatcggcagcgcacaccccaagacaatcagctggcctatgtggttatcggcctgctctttatgattcttacagtggctgccaacgagatggggctgctggaaacgaccaaaaaggatctcggaatcggccacgtcgccgctgagtcccaccatcacgccgcgatgctggacgtggatcttcatcctgccagcgcttggacactgtacgccgtcgctaccacaatcattacccccatgatgagacacacgatcgaaaacaccacagccaatatttctctcaccgcgatcgccaaccaggctgccattctgatgggcctggacaaagggtggcctatctccaagatggatattggagtgcccctccttgctctgggctgctacagccaagttaatccgctgacactcaccgccgctgtgctgatgcttgtcgcccattatgcgatcatcgggcctggactgcaggccaaggctacgcgggaggcccagaaacgcacagctgccggcattatgaagaaccccaccgtggacgggatcgttgccattgatctcgaccccgtggtctacgatgcgaaattcgaaaagcagctgggacaaatcatgctgctcattctttgtacatctcagatcctgctgatgagaaccacctgggctctctgcgagagcatcacactggccacgggccctcttaccacactgtgggagggctccccggggaaattttggaataccacaattgctgtgtctatggccaacatcttccggggaagctatctcgccggcgctgggctggccttctccctgatgaaaagcctcggaggcgggcgcagaggaaccggcgcgcagggcgaaacgcttggggagaagtggaaacggcagctgaatcaactgtccaagtctgaatttaacacatacaaacgcagcggaattatggaggtggacagatccgaagccaaggagggcctcaaaagaggggaaaccaccaagcacgctgtttctcggggaacagccaagctgcgctggttcgtcgaacggaatcttgtgaaacccgagggcaaggtgatcgacctggggtgtggaagaggcggctggagctattactgcgctgggctcaaaaaggtcaccgaagttaaaggatatacaaagggcgggcctggacacgaggaacccattcctatggccacgtacggctggaacctggtgaaactgtactccgggaaggatgtgtttttcacaccccctgagaagtgtgacaccctcctttgcgatatcggagagtctagcccgaatcccaccatcgaagagggccgcacactgcgggtcctgaaaatggtggaaccttggctcagaggcaaccagttttgtattaaggttctgaatccctatatgccttccgtggtcgagacccttgagcagatgcagcgcaaacatgggggaatgctggtgcggaaccccctcagcagaaattctacgcacgaaatgtactgggtttcctgcggcaccgggaacatcgtgagcgcggtcaatatgacatctcgcatgctgctgaaccggttcaccatgacacatagaaagccgacctatgagaaagacgtggatctcggagccggcacacgccacgtggctgtcgaacctgaggttgccaacctggacattatcgggcaacggattgaaaatatcaagaacgagcacaagtccacctggcattacgatgaggacaatccctataaaacgtgggcttaccacggaagctatgaagtgaagccctctggctccgccagctccatggtgaacggcgtcgtgagacttctgacaaaaccttgggatgttattcccatggtgacccagatcgctatgaccgacacaacgccttttgggcagcaacgcgtcttcaaggagaaagtggataccagaacaccgaaggccaagcggggaaccgcgcagatcatggaagttacagcccgctggctctggggctttctgagcagaaataaaaagccccggatttgtaccagagaggagttcacacggaaagtgcgctctaacgctgccatcggggctgtctttgtggacgagaatcagtggaacagcgccaaggaggccgttgaagacgagagattctgggatcttgtgcatcgggaacgcgagctgcacaaacagggaaagtgcgcgacctgcgtctacaatatgatgggcaagagagagaagaagctcggggagtttggcaaagctaagggatcccgggccatttggtacatgtggctgggcgcccgcttcctggagttcgaagctctcgggtttatgaacgaggaccattggttctctagagaaaatagcctgtccggagtggagggcgaggggcttcacaaactgggatatatcctccgggatatttctaagatccctggcgggaacatgtacgccgacgatacggctggctgggacacccgcatcacagaagatgacctgcaaaatgaggccaaaattaccgatatcatggaacccgagcacgcgcttctggccacaagcatttttaagctcacctatcagaacaaggtcgtgagagttcagcggcctgctaaaaatggaacggtgatggacgtcatctcccgcagagatcagcggggctctgggcaagtgggaacatacggcctgaacaccttcacaaacatggaagcccagctgattcgccagatggagagcgaggggatctttctcccctccgaactggagaccccgaatcttgctgaaagagtgctggactggctcgagaagcatggaacggaacggctgaaaagaatggccatcagcggcgatgactgtgttgtgaagcctattgacgatcgcttcgcgaccgcccttacagctctgaacgacatggggaaagtccggaaggatatcccccagtgggagccttctaagggctggaatgactggcaacaggtgcccttttgctcccaccatttccaccagctcattatgaaagatggaagagagatcgttgtgccttgtcgcaaccaggacgaactggtcggccgggccagagtgagccaaggggctggatggtctctgcgcgagaccgcctgcctcggcaagtcctatgctcagatgtggcagctgatgtactttcaccggagagatcttcgcctggccgcgaatgccatttgtagcgctgtccccgtggactgggttccgacatcccggaccacatggtctatccatgcccaccatcaatggatgaccacggaagatatgctcagcgtgtggaacagagtctggatcgaggaaaatccttggatggaggacaaaacacacgtgtccagctgggaggatgttccctatctggggaagcgcgaagaccagtggtgcggatctcttattggcctgaccgcccgggctacctgggccacaaacatccaggtggcgattaatcaggtcagacggctcatcgggaacgagaattacctggactacatgacctccatgaaaagattcaagaacgaaagcgatcccgagggcgctctgtggtga

SEQ ID NO: 18455 - RNA, 9879 nt, synthetic construct
  misc_feature 1..9879: note = derived and/or modified CDS sequence (opt5) from DENV-1__LC011945__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagaccagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagcacaaatactcttggaaaagctggggaaaggccaaaattatcggcgctgacgtgcagaataccacctttatcattgatgggcctaacacacccgaatgtcctgacgatcagagagcgtggaatatctgggaggtcgaggactatggattcggcatttttaccacgaacatctggctgaagctgcgcgattcctacacacaggtttgcgaccaccggcttatgagcgccgctattaaagattctaaggccgtgcatgccgacatgggctattggatcgaatccgagaaaaatgaaacctggaagctcgctagagccagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgcgggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgctacagaggggaggacggatgctggtatggcatggagattcggccggtgaaagaaaaggaggaaaatcttgttaagagcatggtgtctgctgggtccggagaggtcgacagcttctccctcggcctgctgtgtatctctattatgatcgaagaggtgatgagaagccgctggtcccggaaaatgctcatgacagggaccctggccgtctttttccttctgattatgggacagctcacatggaacgatctgatcagactgtgcattatggtgggcgccaatgcttctgaccgcatgggcatggggaccacctaccttgccctgatggcgacatttaagatgagacctatgttcgctgtcggactcctgtttcggcgcctcacgagcagagaggtgctgcttctgaccatcggcctctccctggtggcctctgtcgaactgcccaacagccttgaggaactgggggatggactcgccatgggcatcatgattctgaaactcctgacagacttccaatcccaccagctttgggctaccctgctcagcctgacatttatcaagaccacgttctctctgcattatgcctggaaaacaattgctatggttctttccatcgtgagcctgtttcccctctgtctgtctaccacctcccagaagacaacctggctccctgtgctgcttgggagcctgggatgcaagccgctgacaatgttcctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcacagcggcgcgtcccataatatcctcgtggaagttcaggatgacgggacgatgaaaatcaaggatgaggagcgcgacgataccctgacaattcttctgaaagccaccctcctggctgtgtctggagtctatcctctcagcatccccgccacactgtttgtgtggtacttctggcaaaagaagaaacagagatccggcgtcctttgggacaccccttctcccccggaagtggagcgggccgttctggatgacggcatttatcgcatcatgcagagagggctgctcggacggagccaggtgggcgtcggggtgttccaagaaaacgtttttcacacgatgtggcacgtgacccgcggagctgtcctgatgtaccagggcaagagacttgagccttcctgggccagcgtgaaaaaggacctgatttcttacgggggaggctggcggctccagggctcctggaatacaggggaggaagtgcaggttatcgcggtcgagcccggcaaaaatcctaagaatgtgcaaaccgctcccggcacattcaagaccccggaaggggaggtgggagccattgccctggattttaaacctggcacaagcgggtctcccatcgtcaacagagaaggaaagatcgtgggcctctatggcaatggggttgtgacgacctccggaacatacgtcagcgctattgcccaggcgaaggcttcccaggagggccctctgcccgagatcgaagacgaggtgttccgcaagcggaaccttaccattatggatctgcatcccgggtctggaaaaaccagacgctatctgcctgccatcgttcgggaagccattaagagaaagctccgcacactgatccttgctccgacgcgggtggtcgccagcgagatggctgaagccctgaaaggcatgcccatcagataccaaaccacagcggtgaagtccgagcacaccgggaaagagattgttgacctcatgtgccatgccacatttaccatgcgcctgctgagccctgtgcgggtccccaattataacatgatcattatggatgaagctcacttcacggacccttcttccatcgccgctagaggctacattagcacacgggtgggaatgggcgaggccgccgctatctttatgaccgcgacaccccctgggtctgtggaagccttcccgcagagcaatgctgtcatccaggatgaggaacgcgacattcccgagagatcctggaactctggatatgagtggatcacagattttcctggcaagaccgtttggttcgtgcccagcattaaatccgggaatgacatcgccaactgtctccggaagaatggaaagcgcgtgattcagctttctagaaaaacatttgataccgaataccaaaagacgaaaaacaacgactgggactacgtcgtgacaaccgatatcagcgagatgggcgccaatttccgggctgacagagttattgatcctcgccggtgcctgaagcccgtgatcctgaaagacgggtccgaaagagtcatcctcgccggcccgatgcctgtgacagttgcgagcgctgcccagcgccggggaagaattggccgcaaccataataaggagggggatcagtatatctacatgggacagcccctgaacaatgacgaggatcacgcccactggaccgaagctaagatgcttctggacaacattaatacgcccgagggcatcattcctgccctcttcgaacccgagcgggaaaaatctgcggccatcgatggggagtatagactgcgcggagaggctagaaagacctttgtggaactgatgcggcgcggcgacctccctgtctggctttcctacaaagtggccagcgaggggttccaatattccgatagacggtggtgctttgacggcgaacgcaacaatcaggtcctggaggaaaacatggatgtggagatctggacaaaggagggagaacgcaagaaactgcggccgagatggctcgacgctcgcacctactctgaccccctggcccttcgggagttcaaagaatttgctgccggcagacgcagcgtttccggggatctgattctcgagatcggaaagctgcctcagcatctgacacagcgggcgcaaaatgccctcgacaaccttgtgatgctgcacaattctgaacagggcgggagagcttatcggcatgccatggaggagctgcccgataccattgaaacactcatgctgcttgctctgatcgccgtgctcaccggaggcgtcacgctgttctttctgagcggcaaggggctcggaaaaacatccattggccttctgtgtgttatggccagctctgtgctgctctggatggcttccgtggagcctcactggatcgcggccagcatcattctggagttctttcttatggtcctgctcatccccgagccggaccgccagagaacccctcaggataaccaactggcttacgtggttattgggctcctgttcatgatccttaccgtggccgccaatgagatgggactgctggaaacaaccaagaaagacctcggcattgggcacgtcgctgtggagaaccatcaccatgccgcgatgctggatgtcgaccttcaccccgcctctgcttggacactgtacgccgtggctacgaccatcattacacctatgatgcggcataccatcgaaaacacaaccgccaatatctccctcacggcgattgccaaccaggctgccatcctgatgggactggataagggctggcccattagcaaaatggacatcggcgttcctctccttgctctggggtgctattctcaggtgaatcccctgaccctcacagccgctgtcctgatgcttgtggcccactacgcgattatcggaccgggcctgcaagccaaggctacccgcgaggcccagaagagaacagctgccgggatcatgaaaaaccctaccgttgatggaattgtggccatcgacctcgatcccgtcgtgtatgacgcgaagtttgaaaaacagctgggccagattatgctgctcatcctttgtacgagccaaattctgctgatgcggacaacctgggctctctgcgagtccatcacactggccaccgggccccttaccacactgtgggagggatctcctggcaagttctggaatacgaccatcgctgtgagcatggccaacatttttcgcggctcctacctcgccggggctggactggccttcagcctgatgaaatccctcggcgggggaagacggggcacaggggcgcagggagaaacccttggcgagaagtggaagcgccagctgaatcagctgtctaaaagcgagttcaacacatataagagatccggcatcatggaggttgaccggtctgaagccaaagaggggctcaagagaggagagaccacgaaacacgctgtcagccgcggcacagccaagctgcggtggtttgtggaaagaaatcttgtgaagccggaggggaaagtcattgatctgggatgtggccgcgggggatggtcctactattgcgctggcctcaagaaagttaccgaagtgaagggctacaccaaagggggacccggccatgaggaacctgtgcccatggccacatacgggtggaacctggtcaagctgcactctggaaaagacgtgttctttatccctcccgagaagtgtgataccctcctttgcgacattggcgagagctcccctaatccgacaatcgaagaggggcggacgctgagagttctgaagatggtggaaccctggctccgcggaaaccaattctgtattaaaatcctgaatccttatatgcccagcgtcgtggagacccttgagcagatgcagcggaagcatggcggcatgctggttagaaaccctctctctcgcaattccacacacgaaatgtactgggtgagctgcgggaccggaaacatcgtctctgcgattaatatgacatcccggatgctgctgaacagatttaccatggcccaccgcaaacccacgtatgagcgggatgtggacctcggcgctgggaccagacatgtggccgtcgaaccggaggttgctaacctggatatcattggacagcgcatcgaaaatattaagtgtgagcacaaaagcacatggcattacgacgaggataacccttataagacctgggcctaccacggctcttatgaagtgaagccctccgggagcgcttccagcatggtgaatggagtcgtgaaacttctgacaaagccctgggacgttatccctatggtgacccaaatcgccatgacagataccacgcccttcggccagcagagagtctttaaagagaaggtggacacacggacccctaaagcgaagcgcggcaccgcccaaattatggaagttacagctagatggctctgggggttcctgtctcggaacaagaaaccgagaatctgcacgcgggaggaatttacccgcaaggtgagaagcaatgccgctattggagccgtcttcgtggacgagaaccagtggaactccgccaaagaggcggttgaagatgagcggttttgggaccttgtgcatcgcgaaagagagctgcacaagcagggcaaatgcgctacatgtgtctacaacatgatggggaagcgggaaaagaaactcggagagttcggcaaggccaaagggtctcgcgccatctggtacatgtggctgggcgctagatttctggagttcgaagccctcggattcatgaatgaggatcactggtttagccgggaaaactccctgtctggcgtggagggggagggacttcataagctgggctatattctccgcgacatcagcaaaatctccgggggaaatatgtacgctgatgacaccgccggctgggatacaagaattaccgaagacgatctgcagaacgaggcgaagatcacagaaattatggagcccgaacacgcccaacttgctaaagccatcttcaagctgacctatcagaataaggtcgtgcgggttcagcgccctgctaaaaacgggacggtgatggacgtcatttctagacgggatcagcgcggcagcggacaagtgggcacctacgggctcaatacatttaccaacatggaggcccagctgatcagacagatggagtccgaaggaatcttcagcccctctgagctggaaacacctaacctcgcggagcgggtgctggactggcttgaaaagtatggcgttgagagactgaaacgcatggccatttccggggatgactgcgtggtcaagcccatcgacgatcggtttgctaccgccctcacggctctgaatgacatgggaaaagtgagaaaggatattccgcagtgggagcctagcaagggctggaacgactggcaacaggttcccttctgttctcatcactttcaccagcttatcatgaaagatgggcgcgaaattgtggtcccttgccggaatcaggacgagctggtgggcagagcccgcgtctcccaaggagctggctggagcctccgggaaacagcctgtctggggaagtcctacgcgcagatgtggcagctgatgtatttccatagacgcgatctccggctggccgctaacgccatctgctctgccgtgcccgttgactgggtgcctaccagcagaacaacctggtccattcacgctcatcaccaatggatgacgaccgaggatatgcttagcgtctggaatcgcgtgtggatcgaagagaacccctggatgaaagacaagacacatatctcttcctgggaggatgttccgtacctgggaaaacgggaagaccagtggtgtggcagcctcattgggctgaccgccagagcgacatgggctaccaatatccaggtggccattaaccaggtccggagacttatcggaaatgagaactacctggactatatgacatctatgaagcgctttaagaatgaaagcgatcctgagggcgccctctggtga

SEQ ID NO: 18456 - RNA, 9879 nt, synthetic construct
  misc_feature 1..9879: note = derived and/or modified CDS sequence (opt5) from DENV-1__LC011949__SS-prME
  source 1..9879: mol_type = other RNA
agcgtgaccatgctgctcatgctggtccccacagcccttgctttccacctgacgaccagaggaggggaacctcatatgatcgtttccaagcaggaacgggggaaatctctcctgtttaagaccagcgccggcgtgaacatgtgcacccttattgcgatggacctgggggagctctgtgaagatacaatgacctacaaatgcccgcgcatcacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagattcagcgggtggaaacatgggctctgcgccaccccggcttcaccgtcatcgccctttttctggcgcatgccattgggacatctatcacccagaagggaatcattttcatcctcctgatgcttgtgacccctagcatggctatgagatgcgttggcattgggtcccgggattttgtggagggactgagcggcgccacatgggtcgacgtggtgctcgagcacgggtcttgtgtcacgaccatggctaaggataaacccacactggacatcgaactgctcaagaccgaggttacaaaccctgccgtgctgcgcaaactttgcattgaagcgaagatctccaataccacgacagatagcagatgtccgacccaaggagaggccaccctggtggaagaacaagacgctaacttcgtctgccggcgcacatttgtggatagaggctggggcaatgggtgtggactcttcggcaaagggtctctgattacctgcgccaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagctaccattacgccccaggcccctaccacagagatccagctcaccgactacggcgccctgacactggattgttctccccggaccggcctcgacttcaacgaaatggtcctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggttgtgctgggaagccaagagggcgctatgcacacagccctgacgggggccaccgaaattcagacatccggaaccacaaccatctttgctggccatctcaaatgcagactgaagatggataaacttacgctgaaggggacaagctatgtcatgtgtaccggctctttcaaactcgagaaggaagtggccgagacccagcacggaacagttctggtgcagattaagtacgagggcaccgacgcgccgtgcaaaatccctttctccacacaagatgaaaagggggtcacgcagaacggacggctgatcaccgctaatcccattgtgacagacaaagagaagcctgtgaacatcgaagccgagccgccctttggcgagagctatattgttatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtctttaccagcgtgggcaaactggtgcatcagattttcgggacggcttacggagtcctcttttccggcgtgagctggaccatgaagatcgggattggcgttctgcttacatggctgggactcaattctagatccaccagcctgtctatgacatgtatcgccgtgggcctggtcaccctttacctcggggtgatggttcaggctgatacaggatgcgtgattaactggaaaggccgcgaactgaagtgtgggtccggaatcttcgtcaccaatgaggtgcacacgtggacagaacaatataagtttcaggccgacagccctaaacggctgtccgcggccattggcaaggcttgggaggagggggtttgcggcatcagatctgccacccgcctcgaaaacatcatgtggaaacagattagcaacgagctgaatcatatccttctggaaaacgacatgaagttcaccgtggtcgtgggagatgtggctggcattctcgcccaggggaaaaagatgatccggccgcaacccatggagtacaaatattcctggaagtcttggggaaaggccaaaattatcggcgctgacgtccagaatacaacctttatcattgatgggcctaacacgcccgaatgtcctgacgatcagagagcgtggaatatctgggaggttgaggactacggattcggcatttttacaaccaacatctggctgaagctgcgcgatagctatacacaggtgtgcgaccaccggcttatgtccgccgctattaaagatagcaaggccgtgcacgccgacatgggctactggatcgaatctgagaaaaatgaaacctggaagctcgctagagcctccttcatcgaggtcaagacatgtatttggcccaaaagccataccctgtggtctaacggggtgctggaatccgagatgatcattccgaagatctatggaggccctattagccaacacaattaccgccccgggtacttcacgcagaccgcgggaccttggcatctcggcaaactggagcttgattttgacctgtgcgaagggacaaccgttgtggtcgatgagcactgcggaaaccggggcccctctctcagaacaaccacggtgacaggcaagatcatccacgaatggtgttgccggagctgtaccctgcctcccctgcgcttcagaggggaggacggatgctggtatggcatggagattcggccggttaaagaaaaggaggaaaatcttgtgaagtccatggtcagcgctgggtctggagaggtggactcctttagcctcggcctgctgtgtatctccattatgatcgaagaggttatgagatctcgctggagccggaaaatgctcatgacagggaccctggccgtgttctttcttctgattatgggacagctcacctggaacgatctgatcagactgtgcattatggtcggcgccaatgcttccgaccgcatgggcatggggacaacgtaccttgccctgatggcgaccttcaagatgagacctatgtttgctgtgggactcctgttccggcgcctcacatctagagaggtgctgcttctgaccatcggcctcagcctggtcgcctccgttgaactgcccaactctcttgaggaactgggggatggactcgccatgggcatcatgattctgaaactcctgacagactttcaaagccatcagctttgggctaccctgctctccctgacgttcatcaagacaacctttagcctgcactatgcctggaaaaccatggctatggtgctttctattgtgtccctgttccccctctgtctgagcacaacctctcagaagacaacgtggctccctgtcctgcttgggtccctgggatgcaagccgctgaccatgtttctcatcgccgagaataaaatttggggccggaagtcctggcccctgaacgaaggcatcatggcggtggggatcgtttctattcttctgtccagcctcctgaaaaacgatgtgcctctcgccggacccctgatcgctggcgggatgcttattgcctgttacgtcatctccggaagctctgctgacctgagcctggagaaggccgccgaggtgtcctgggaagaggaagctgagcattctggcgcgagccacaatattctcgttgaagtgcaggatgacgggacaatgaaaatcaaggatgaggagcgcgacgataccctgacaatccttctgaaagccaccctcctggctgtctccggagtgtatcctctctctattcccgccacgctgttcgtctggtacttctggcaaaagaagaaacagagaagcggcgtgctttgggacacccctagccctcccgaagttgagcgggccgtgctggatgacggcatctatcgcattatgcagagagggctgctcggacggtctcaggtcggcgtgggggtttttcaagaaaacgtgttccatacaatgtggcacgtcacccgcggagctgtgctgatgtaccagggcaagagacttgagcccagctgggcctccgtgaaaaaggacctgatcagctacgggggaggctggcggctccagggctcttggaatacaggggaggaagttcaggtcattgcggtggagcccggcaaaaatcctaagaatgtgcaaaccgctcccggcacatttaagacgccggaaggggaggtcggagccatcgccctggatttcaaacctggcacctccgggagccccattgtgaacagagaaggaaagatcgttggcctctatggcaatggggtggtcacaacctctggaacctacgtgtccgctatcgcccaggcgaaagctagccaggagggccctctgcccgagattgaagacgaggtttttaagaaacgcaaccttacaatcatggatctgcaccccgggtccggaaagacgcggagatatctgcctgccattgtgcgcgaagccatcaagcggaaactcagaaccctgattcttgctccgacacgcgtcgtggcctctgagatggctgaagccctgaagggcatgcccatccggtaccaaaccacagcggttaaaagcgagcataccgggaaggagatcgtggacctcatgtgccacgccacgttcacaatgagactgctgtcccctgtccgcgtgcccaattataacatgattatcatggatgaagctcattttaccgaccctagctctattgccgctcggggctacatctccaccagagtgggaatgggcgaggccgccgctattttcatgacagcgacaccccctgggagcgtcgaagcctttccgcagtctaatgctgttatccaggatgaggaacgggacatccccgagcgcagctggaactccggatatgagtggattacagatttccctggcaaaaccgtgtggtttgtgccctctatcaagagcgggaatgacattgccaactgtctcagaaagaatggaaaacgggtcatccagctttcccgcaagacgttcgatacagaataccagaaaaccaagaacaacgactgggactacgtggttacaaccgatatttctgagatgggcgccaatttcagagctgaccgggtgatcgatcctagacgctgcctgaaacccgtcattctgaaggacgggccggaacgggtgatcctcgccggccctatgcccgttacggtggcgagcgctgcccagagacgcggacggatcggcagaaaccacaataaggagggggatcagtatatttacatgggacagcccctgaacaatgacgaggatcatgcccactggaccgaagctaaaatgcttctggacaacatcaatacacctgagggcattatccccgccctctttgaacctgagcgcgaaaagtccgcggccattgatggggagtatcggctgagaggagaggctcgcaaaaccttcgtcgaactgatgagacggggcgacctcccggtgtggcttagctacaaggtcgcctctgaggggtttcaatattccgatcgcagatggtgcttcgacggcgaacggaacaatcaggtgctggaggaaaacatggatgttgagatctggacaaaagagggagaacgcaagaaactgagaccccggtggctcgacgctagaacctacagcgaccctctggcccttcgcgagtttaaggagttcgctgccggccggagatccatctctggggatctgattctcgagatcggaaagctgccccagcacctgacacagcgcgcgcaaaatgccctcgacaaccttgtgatgctgcataatagcgaacagggcgggcgggcttatagacacgccatggaggagctgcctgataccattgaaacgctcatgctgcttgctctgatcgccgtgctcacaggaggcgtcaccctgtttttcctgtccggccgggggctcggaaaaacctctattggccttctgtgtgttatggccagctccgtgctgctctggatggctagcgtggagccccattggatcgcggcctctatcattctggaatttttccttatggtcctgctcatcccggagcctgaccgccagagaacaccccaggataaccaactggcttacgtggttattgggctgctctttatgatccttaccgtggccgccaatgagatgggactgctggaaacaacgaagaaagacctcggcattgggcacgtcgctgtggagaaccaccatcacgccgcgatgctggatgtcgaccttcatcctgcctccgcttggaccctgtacgccgtggctacaaccatcattacacccatgatgcggcacaccatcgaaaacacgaccgccaatatcagcctcacagcgattgccaaccaggctgccatcctgatgggactggataagggctggcctatttctaaaatggacatcggcgttcccctccttgctctggggtgctattcccaggtgaatccgctgaccctcacagccgctgtcctgatgcttgtggcccattacgcgattatcggacctggcctgcaagccaaggctacccgcgaggcccagaagagaacggctgccgggatcatgaaaaaccccacagttgatggaattgtggccatcgacctcgatcccgtcgtgtatgacgcgaagttcgaaaaacagctgggccagattatgctgctcatcctttgtaccagccaaattctgctgatgcggacaacctgggctctctgcgagtctatcaccctggccacagggcctcttacgaccctgtgggagggaagcccgggcaagttttggaatacaaccatcgctgtgtccatggccaacattttccgcggctcttacctcgccggggctggactggccttcagcctgatgaaatccctcggcgggggaagacggggcacaggggcgcagggagaaacccttggcgagaagtggaagcgccagctgaatcagctgagcaaatccgaatttaacacgtataagagatctggcatcatggaggttgaccggagcgaagccaaagaggggctcaagagaggagagacaaccaaacacgctgtctcccgcggcaccgccaagctgcggtggttcgtggaaagaaatcttgtgaagcccgaggggaaagtcattgatctgggatgtggccgcgggggatggtcttactattgcgctggcctcaagaaagttacagaagtgaagggctacaccaaagggggacctggccacgaggaacccatccctatggccacatacgggtggaacctggtgaagctgcatagcggaaaagacgtctttttcattccccctgagaagtgtgatacgctcctttgcgacatcggcgagtcctctccgaatcccaccattgaagaggggcggacactgagagtgctgaagatggttgaaccttggctccgcggaaaccaattttgtatcaaaatcctgaatccctatatgcctagcgtggtcgagacccttgagcagatgcagcggaagcacggcggcatgctggtgagaaaccccctctcccgcaatagcacacatgaaatgtactgggtttcttgcgggaccggaaacattgtgtccgcggtcaatatgacgagccggatgctgctgaacagattcaccatggcccaccgcaaaccgacatatgagcgggatgtggacctcggcgctgggaccagacacgtggccgtcgaacctgaggttgctaacctggatatcattggacagcgcatcgaaaatattaagcatgagcacaaatctacatggcattacgacgaggataacccctataagacctgggcctaccacggctcctatgaagtgaagcccagcgggtctgcttccagcatggtgaatggagtcgtgaaacttctgacaaagccttgggacgttatccccatggtgacccaaatcgccatgacggatacaaccccttttggccagcagagagtcttcaaagagaaggtggacacccggacaccgaaagcgaagcgcggcacggcccaaattatggaagttaccgctagatggctctgggggtttctgtcccggaacaagaaacccagaatctgtacacgggaggagttcacccgcaaggtgagaagcaatgccgctattggagccgtctttgtggacgagaaccagtggaactctgccaaagaggcggttgaagatgagcggttctgggaccttgtgcatcgcgaaagagagctgcacaagcagggcaaatgcgctacatgcgtctacaacatgatggggaagcgggaaaagaaactcggagagtttggcaaggccaaagggagccgcgccatctggtacatgtggctgggcgctagattcctggagttcgaagccctcggatttatgaatgaggatcactggttctcccgggaaaactctctgagcggcgtggagggggagggacttcataagctgggctatattctccgcgacatctccaaaatccctgggggaaatatgtacgctgatgacaccgccggctgggatacaagaattaccgaagacgatctgcagaacgaggcgaagatcacggacattatggaacccgagcacgcccttctggctaaagccatctttaagctcacctatcaaaataaggtcgtgcgggttcagcgccctgctaaaaacgggacagtgatggatgtcatttctagacgggaccagcgcggcagcggacaggtgggcacctacgggctgaatacattcaccaacatggaagcccaactgatcagacagatggagtccgagggaatctttctcccctctgaactggagacgccgaaccttgcggaacgggtgctggattggctcgagaagtatggcgttgaaagactgaaacgcatggccattagcggggacgactgtgtggtcaagcctatcgatgaccggttcgctacagcccttaccgctctgaatgatatgggaaaagtgagaaaggacattccccagtgggagccttccaagggctggaacgattggcagcaagttcccttttgcagccatcacttccaccagctcatcatgaaagacgggcgcgagattgtggtcccttgtcggaatcaggatgaactggtgggcagagcccgcgtctctcagggagctggctggtccctgcgggagacagcctgcctcggaaagagctacgcgcaaatgtggcagctgatgtattttcatagacgcgaccttcggctggccgctaacgccatctgttctgccgtgcccgttgattgggtgccgacctccagaacgacctggagcattcacgctcatcaccagtggatgacaaccgaagacatgctctccgtctggaatcgcgtgtggatcgaggaaaacccttggatggaggataaaacacatatctctagctgggaggacgttccctacctgggaaagcgggaagaccaatggtgcggctcccttattgggctgaccgccagagcgacatgggctaccaatatccaggtggccattaaccaggtccggagactcatcggaaatgagaactacctggattatatgacgagcatgaaacgcttcaagaatgaatctgaccccgagggcgccctgtggtga

SEQ ID NO: 18457 - RNA, 9879 nt, synthetic construct
  misc_feature 1..9879: note = derived and/or modified CDS sequence (opt5) from DENV-1__HM469966__SS-prME
  source 1..9879: mol_type = other RNA
agcgtgaccatgctgctcatgctgatgcccaccgcccttgctttccacctgacgacccggggaggggagcctcatatgatcgtctccaagcaggaacggggaaaatctctcctgtttaagaccagcgccggcgttaacatgtgcacccttatcgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatgacctgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgattctgggagataccgcctgggacttcggctctatcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaaaatcattggcgctgacgtgcagaataccacctttatcatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagcgccgctatcaaagattctaaggccgtgcacgccgacatgggctactggattgaatccgagaaaaatgaaacctggaagctcgctagagccagcttcatcgaggtgaagacatgtatctggcccaaatctcataccctgtggtccaacggggtcctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtggttgtggatgagcactgcggaaaccggggccccagcctcagaacaaccacagtcaccggcaagattatccacgaatggtgttgccggtcctgtacgctgcctcccctgcgcttcagaggggaggacggatgctggtatggcatggagatccggccggtgaaagaaaaggaggaaaatcttgttaagagcatggtgtctgctgggtccggagaggtcgacagcttttccctcggcctgctgtgtatttctatcatgattgaagaggtgatgagaagccgctggtcccggaaaatgctcatgacagggaccctggccgttttctttcttctgatcatgggacagctcacatggaacgatctgattagactgtgcatcatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccattggcctctccctggtggcctctgtcgaactgcccaacagccttgaggaactgggggatggactcgccatgggcatcatgatcctgaaactcctgacagactttcaatcccatcagctttgggctaccctgctcagcctgacattcattaagaccacgttttctctgcactatgcctggaaaacaatggctatggttctttccatcgtgagcctgttccccctctgtctgtctaccacctcccagaagacaacctggctccctgtgctgcttgggagcctgggatgcaagccgctgacaatgtttctcattgccgagaataaaatctggggccggaagtcttggcccctgaacgaaggcattatggcggtcgggatcgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacgatgaaaattaaggatgaggagcgcgacgataccctgacaatccttctgaaagccaccctcctggctgtgtctggagtctatcctctcagcatccccgccacactgttcgtgtggtacttctggcaaaagaagaaacagagatccggcgtcctttgggacaccccttctcccccggaagtggagcgggccgttctggatgacggcatttatcgcatcatgcagagagggctgctcggacggagccaggtgggcgtcggggtgtttcaagaaaacgttttccatacgatgtggcacgtgacccgcggagctgtcctgatgtaccagggcaagagacttgagccttcctgggccagcgtgaaaaaggacctgatttcttacgggggaggctggcggctccagggctcctggaatacaggggaggaagtgcaggttatcgcggtcgagcccggcaaaaaccctaagaatgtgcaaaccgctcccggcacatttaagaccccggaaggggaggtgggagccattgccctggatttcaaacctggcacaagcgggtctcccatcgtcaacagagaaggaaagattgtgggcctctatggcaatggggttgtgacgacctccggaacatacgtcagcgctatcgcccaggcgaaggcttcccaggagggccctctgcccgagatcgaagacgaggtgtttcgcaagcggaaccttaccattatggatctgcaccccgggtctggaaaaaccagacgctatctgcctgccatcgttcgggaagccattaagagaaagctccgcacactgatccttgctccgacgcgggtggtcgccagcgagatggctgaagccctgaaaggcatgcccattagataccaaaccacagcggtgaagtccgagcataccgggaaagagatcgttgacctcatgtgccacgccacattcaccatgcgcctgctgagccctgtgcgggtccccaattataacatgatcattatggatgaagctcattttacggacccttcttccatcgccgctagaggctacattagcacacgggtgggaatgggcgaggccgccgctatcttcatgaccgcgacaccccctgggtctgtggaagcctttccgcagagcaatgctgtcattcaggatgaggaacgcgacatccccgagagatcctggaactctggatatgattggatcacagacttccctggcaagaccgtttggtttgtgcccagcattaaatccgggaatgatatcgccaactgtctccggaagaatggaaagcgcgtgattcagctttctagaaaaacattcgacaccgagtaccaaaagacgaaaaacaacgactgggattacgtcgtgacaaccgacatcagcgaaatgggcgccaatttccgggctgatagagttattgaccctcgccggtgcctgaagcccgtgatcctgaaagatgggccggagagagtcgtgctcgccggccctatgcccgttacagtggcgtccgctgcccagcgccggggaagaattggccgcaaccacaataaggaaggggaccagtatatctacatgggacagcccctgaacaatgatgaggaccatgcccactggaccgaggctaagatgcttctggataacatcaatacgcctgaaggcattatccccgccctctttgagcctgaacgggagaaaagcgcggccattgacggggaatatagactgcgcggagaggctagaaagaccttcgtcgagctgatgcggcgcggcgatctcccggtgtggctttcttacaaagtcgcctccgaagggtttcaatatagcgacagacggtggtgcttcgatggcgagcgcaacaatcaggtgctggaagagaacatggacgttgaaatctggacaaaggagggagagcgcaagaaactgcggcccagatggctcgacgctcgcacctactccgatcctctggcccttcgggaatttaaagagttcgctgccggcagacgctctgtgagcggggacctgattctcgaaatcggaaagctgccccagcacctgacacagcgggcgcaaaatgccctcgataaccttgtgatgctgcataattccgagcagggcgggagagcttatcggcacgccatggaagaactgcctgacaccatcgagacactcatgctgcttgctctgattgccgtcctcaccggaggcgttacgctgtttttcctgtctggccgcgggctcggaaagacaagcatcggccttctgtgtgtgatggcctccagcgtgctgctctggattgcttctgtcgaaccccattggatcgcggcctccattatcctggagtttttccttatggtgctgctcatcccggaacctgatagacagcggacaccccaggacaaccaactggcttacgttgtgattgggctgctctttatgatccttaccgtcgccgccaatgagatgggactgctggagacaaccaaaaaggatctcggcattgggcacgtggctgtcgaaaaccaccatcacgccgcgatcctggacgtggatcttcatcctgccagcgcttggacactgtacgccgttgctacgaccattatcacacccatgatgcgccacaccattgagaacacaaccgccaatatctctctcacggcgatcgccaaccaggctgccattctgatgggactggacaaaggctggcctatctccaagatggatattggcgtgcccctccttgctctggggtgctatagccaggtcaatccgctgaccctcacagccgctgtgctgatgcttgttgcccattacgcgatcattggacctggcctgcaagccaaagctaccagagaagcccagaagcggacagctgccgggatcatgaagaaccccaccgtggacggaatcgtcgccattgatctcgaccccgtggtgtatgacgcgaaattcgagaagcagctgggccagatcatgctgctcattctttgtacgtctcaaatcctgctgatgcgcacaacctgggctctctgcgaaagcattacactggccaccgggcctcttaccacactgtggaaaggatccccgggcaagttttggaatacgaccatcgctgtttctatggccaacatcttcagaggcagctacctcgccggggctggactggccttctccctgatgaaaagcctcggcgggggacggcgcggcacaggggcgcagggagagacccttggcgagaagtggaagagacagctgaatcagctgtccaaatctgaatttaacacatataagcggagcggcattatggaggtcgatagatccgaagccaaagaggggctcaagcgcggagaaaccacgaaacacgctgtgtctcggggcacagccaagctgagatggttcgtggagcgcaatcttgtcaagcccgaggggaaagttatcgacctgggatgtggcagagggggatggagctactattgcgctggcctcaagaaagtgaccgaagtgaagggctacaccaaagggggacctggccacgaggaacccattcctatggccacatacgggtggaacctggtcaagctgtattccggaaaagatgtgtttttcattccccctgagaagtgtgacaccctcctttgcgatattggcgaatctagcccgaatcccacaatcgaggaggggagaacgctgcgcgttctgaagatggtggaaccttggctccggggaaaccaattttgtattaaaatcctgaatccctacatgccttccgtcgtggagacccttgaacagatgcagagaaagcatggcggcatgctggttcgcaaccccctcagcagaaattctacacacgagatgtattgggtgtcctgcgggaccggaaacatcgtcagcgcggtgaatatgacatctagaatgctgctgaaccgcttcaccatggcccatcggaaaccgacgtacgagagagacgtggatctcggcgctgggacccgccacgtcgccgttgaacctgaggtggctaacctggacattatcggacagagaattgaaaatatcaagcacgagcataaatccacatggcactatgatgaagacaacccctacaagacctgggcctatcatggcagctacgaggtgaagccctctgggtccgctagctccatggtcaatggagtggttaaacttctgacaaagccttgggatgtgattcccatggtcacccaaatcgccatgacagacaccacgccttttggccagcagcgggtgttcaaagagaaggttgacacacgcaccccgaaagcgaagagaggcaccgcccaaatcatggaagtgacagctcggtggctctgggggtttctgagcagaaacaagaaaccccggatttgtacgcgcgaggagttcaccagaaaggtccggtctaatgccgctatcggagccgtgtttgttgatgagaaccagtggaatagcgccaaagaagcggtggaggacgagcgcttctgggatcttgtccacagagaacgggagctgcataagcagggcaaatgcgctacatgcgtgtacaacatgatggggaagcgcgaaaagaaactcggagagtttggcaaggccaaagggtccagagccatttggtatatgtggctgggcgctcggttcctggagttcgaggccctcggatttatgaatgaggaccactggttctctcgcgaaaacagcctgtccggcgtcgagggggaaggacttcacaagctgggctacatcctcagagatatttctaaaatccctgggggaaatatgtatgctgacgataccgccggctgggacacacggatcaccgaggatgacctgcagaacgaggcgaagattacagatatcatggaacccgagcatgcccttctggctaaagccatttttaagctcacctaccaaaataaggtggttcgcgtgcagagacctgctaaaaacgggacggtcatggacgtgatcagccggcgcgatcagagaggctccggacaggtgggcacctatgggctgaatacattcaccaacatggaagcccaactgattcggcagatggagtctgaaggaatctttagcccctccgagctcgagacaccgaacctggcggaaagagttcttgactggctggagaagtacggcgtggaacgcctcaaacggatggccatcagcggggacgattgtgtcgtgaagcctattgacgatagattcgctaccgccctgacggctcttaatgacatgggaaaagttcgcaaggatatcccccagtgggagccttctaagggctggaacgactggcagcaagtgcccttttgctcccaccatttccaccagctgattatgaaagatgggcgggaaatcgtcgtgccttgtagaaatcaggacgagctcgtcggccgcgcccgggtgagccagggagctggctggtctctgagagagacagcctgcctggggaagtcctatgcgcaaatgtggcagctcatgtactttcaccgccgggatctgagacttgccgctaacgccatttgtagcgccgttcccgtggactgggtcccgacctcccgcacaacctggtctatccatgctcaccatcagtggatgacgaccgaagatatgctgagcgtgtggaatcgggtttggattgaggaaaacccttggatggaggacaaaacacacatctccagctgggaagacgtgccctacctcggaaagagagaggatcaatggtgcggctctctgatcgggcttaccgcccgggcgacatgggctaccaatattcaggtcgccatcaaccaggtgagacgcctgattggaaatgagaactatctcgactacatgacatccatgaaacggttcaagaatgaaagcgatcccgagggcgccctgtggtga

SEQ ID NO: 18458 - RNA, 9879 nt, synthetic construct
  misc_feature 1..9879: note = derived and/or modified CDS sequence (opt5) from DENV-1__JX669462__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttttggcgggcctatcagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagattatccatgagtggtgttgcagaagctgtacactgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgaccggaacactcgctgtgttcctgcttctgatcatgggccagctcacctggaacgacctgattcggctgtgcatcatggtcggcgccaatgcctccgaccgcatggggatgggaaccacataccttgctctgatggccacgctcaagatgagacctatgtttgcggtgggcctgctcttccggcgcctgacctctagagaagtgcttctgctcacaattgggctgagcctggtcgcttccgttgagcttcccaactctctggaagagctcggagatggcctggccatggggatcatgatgctcaagctgcttaccgaatttcaaccccaccagctgtggacaaccctcctgagcctgacgttcgtgaaaacaaccctttccctggactatgcctggaagaccacagctatggtgctcagcattgtctctctgtttcctctctgtctgtccaccacaagccagaaaacgacctggcttccggtgctgctgggatctttcggctgcaagcccctcacaatgtttctgatcaccgagaacaaaatctggggccggaagtcctggcctcttaatgaggggattatggccatcggaattgttagcatcctgctctcttccctgctcaagaacgatgtgcccctggctggccctcttattgccgggggaatgctgatcgcgtgttacgtcatcagcggctccagcgccgacctgtctctcgaaaaagctgccgaggtgagctgggaacaggaggctgaacattccggggcctctcacaatattctggttgaggtgcaagatgacggaacaatgaagatcaaagatgaggaacgcgacgatacccttacgattctgctcaaggccaccctgctcgctgtcagcggcgtgtatcccatgtccatccctgcgacactgttcgtctggtacttctggcagaaaaagaaacagagatctggcgtgctttgggacacccccagcccgcctgaggttgaacgggccgtgctggatgacgggatttatcgcatcctgcagagaggactcctgggccggtcccaagtcggggtgggagtttttcaggatggcgtgttccatacaatgtggcacgtcaccagaggggctgtgcttatgtaccagggaaagcgcctggagccctcttgggccagcgtgaagaaagacctcatctcctatggcggcgggtggcggtttcagggaagctggaacacaggcgaggaagttcaagtcattgccgtggagcctgggaagaatcccaaaaacgtgcagacgaccccgggaacattcaagacccctgaaggcgaggtcggggctatcgccctggactttaaacccggaacctctggctcccctattgtgaatagagaaggcaagatcgttgggctctacggaaacggcgtggtcacaacgagcgggacctacgtgtctgcgattgctcaggccaaggcctcccaagagggacccctgcccgagatcgaagatgaggttttcaaaaagcgcaatcttacaattatggacctgcaccctggcagcgggaaaacccggagatatctgccggctatcgtgcgcgaagccatcaagcggaaactcagaacactgattcttgcgcccacccgcgtcgtggcttccgagatggccgaagccctgaagggcatgcctatccggtaccagacgacagctgttaagtctgagcataccggaagagagattgtggatctcatgtgccacgccacctttacaatgcggctgctgagccccgtccgcgtgcctaactataatatgatcattatggacgaagctcatttcaccgatcccgcctccatcgcggccagaggctacatcagcacacgggtggggatgggagaggctgccgctatttttatgaccgccacgcctccgggctctgtcgaagccttcccccagtccaacgctgttatccaggacgaggaacgcgatattcctgagagaagctggaattctgggtatgactggatcacagattttcccggaaaaaccgtgtggttcgtgcctagcattaagtccggcaacgacatcgcgaattgtctccggaaaaacgggaagagagtcatccaactttctcgcaaaacattcgataccgagtaccagaagacgaagaacaatgactgggactatgtggttaccacagatattagcgaaatgggcgccaactttcgggctgacagagtgatcgatccccgccggtgcctgaaaccggtcattctgaaggacggacctgagagagtgatcctcgccggccccatgcccgttaccgtggcctccgctgcccagcgccgggggagaattggacgcaatcagaacaaagaaggcgatcaatacgtctacatggggcagcctctgaataacgacgaggatcacgcgcattggacagaggctaagatgcttctggacaatatcaacacccccgaaggaattatccctgccctcttcgagccggaaagagagaaatctgccgctatcgatggcgaatatcggctgcgcggggaggccagaaagacatttgtggagctgatgcggcgcggcgacctccccgtctggcttagctacaaggtggcgtccgaaggattccagtatagcgatagacggtggtgctttgacggcgagagaaataaccaggttctggaagagaatatggatgtggaaatttggaccaaagagggggagcgcaagaaactgcggcctagatggctcgacgcccgcacgtactctgaccccctggctcttcgggaattcaaggagtttgccgctggaagacggtccgtgagcggcgatctgatcctcgaaattgggaaactgcctcaacacctgacactccgcgcccagaacgctcttgacaatctggtcatgctgcacaactccgagcagggaggcaaggcctatagacatgcgatggaagagctccccgataccatcgagaccctgatgcttctggccctcattgctgttctgacaggcggggtgaccctgttctttctctctggaaaaggccttgggaagacaagcatcggactgctgtgtgtgacggcctcctctgctctcctgtggatggccagcgtcgaaccgcactggatcgccgcttccattatccttgagttctttctgatggtgctcctgattcctgaacccgaccggcagcgcacccctcaagataatcagctggcgtacgttgtgatcggcctccttttcatgattctgacagtcgccgctaacgagatggggctgctcgagaccacaaagaaagacctgggaatcggctatgtggccgccgaaaaccatcagcacgctaccatgcttgatgtcgacctgcaccccgccagcgcgtggacgctctacgccgtggctaccacagttatcacccctatgatgagacatacaattgagaataccacggccaacatctctctgacagctattgccaatcaagcggccatcctgatgggcctcgataaggggtggcccatttccaaaatggacatcggagtgccgcttctggctctgggctgctacagccaggtcaaccctctcaccctgacagccgctgtgcttatgctggttgcccactatgctattatcgggcccggactccaggccaaggcgacccgggaagcccagaaacgcaccgctgccggcatcatgaagaatcccacagtggatgggattgtcgctatcgacctggatcctgtggtgtacgacgccaagtttgagaaacaactgggacagattatgctccttatcctgtgtacgtctcagattctgctcatgagaaccacatgggccctgtgcgaatccatcacccttgcgacaggcccgctgaccacgctctgggagggcagccccgggaagttctggaacacaaccatcgctgtttctatggccaatattttccggggaagctatctggctggcgccgggctggccttttccctcatgaaatctcttggaggcgggcgcagaggaaccggcgctcagggcgagacactgggggaaaagtggaaacggcaactgaaccagctcagcaagtccgagttcaatacctacaagagaagcggaatcatggaagtcgaccgctccgaggccaaagaaggcctgaagcggggggagacaacgaaacatgcggtgtctagaggaaccgccaagcttcgctggtttgtggagcggaacctggtcaaacctgaaggcaaggttattgatctcgggtgtggaagaggcggctggagctattactgcgctgggctgaagaaagtgacagaggtgaagggatataccaaaggcgggcccggacacgaagagcctatccccatggccacatacggctggaatctggtcaagctccattccgggaaagacgtgttctttatgcctccggaaaagtgtgatacccttctgtgcgacattggagagtctagccccaaccctacgatcgaggaaggccgcaccctgcgggttctcaaaatggtggagccctggctgagaggcaatcagttctgtatcaagattcttaacccttacatgccctccgtcgtggaaacactggagcagatgcaacgcaagcacgggggaatgctcgttcggaatccgctgtctagaaacagcacccacgagatgtattgggtgtcctgcggcacagggaatatcgtcagcgctgtgaacatgacctctcgcatgctgctcaaccggtttacaatggcccatagaaaacctacctacgaacgcgatgtggacctgggagcgggcacgagacacgtcgccgttgagcccgaagtggctaatcttgatattatcgggcagcggattgagaacatcaagaatgaacataaatccacatggcactatgacgaggataacccctacaagacctgggcctatcacggaagctacgaggtgaaaccttctggctccgctagctctatggtcaatggcgtggttcgcctgctcaccaagccctgggacgtgattcctatggtcacacagatcgccatgacggataccacaccgttcgggcaacagagagtgtttaaggaaaaagttgacacccggacacccagagctaagcggggaaccacacagatcatggaggtgaccgccaaatggctgtggggcttcctttcccgcaacaagaaacctagaatttgtacgcgggaagagtttacccgcaaggtcagaagcaatgcggccatcggggctgtgttcgttgacgaaaaccagtggaattccgccaaggaggctgtggaggatgaacggttttgggacctggtccatcgcgagagagaactccacaaacaaggaaagtgcgccacatgcgtgtataacatgatgggcaaacgggagaagaaactgggggaattcggcaaggccaagggaagccgcgcgatttggtacatgtggctgggcgctagattcctcgagtttgaggccctggggttcatgaatgaagatcattggttttctcgggagaacagcctttccggagtcgaaggcgaggggctgcacaaactcggatacatcctgcgcgacatttctaagatccccggcgggaatatgtatgccgatgacaccgctggctgggatacaagaatcaccgaggacgatcttcagaacgaagccaaaattacggacatcatggagcctgaacatgctctgctcgccacaagcattttcaagctgacctaccagaataaagtggttcgggtgcagcgccccgcgaagaacggaacagtcatggatgtgatctccagacgggaccaaagaggctctgggcaggtgggaacctatggcctgaacacgtttaccaatatggaggttcagctcattcgccagatggaaagcgaggggatcttcctgccgtccgagcttgaaacacctaacctggccgagcgggctctcgattggctggaaaaacacggagccgagagacttaagcgcatggctatctctggcgacgactgtgtggtcaagcccattgatgaccggtttgccaccgcgctgacagccctcaatgatatggggaaagtgagaaaggacatccctcaatgggaacccagcaaaggctggaacgattggcagcaggttcctttctgctcccaccattttcaccagctgattatgaaggacggacgcgagatcgtggtcccctgtcggaatcaagatgagctggtgggcagagctcgcgtcagccagggggccggatggtctctccgggaaaccgcttgcctgggcaaatcctacgcccagatgtggcaacttatgtatttccatagacgcgacctgcggctcgctgccaacgcgatttgtagcgccgtgccggttgattgggtgcctgcttctagaacaacctggtccatccacgcccaccatcagtggatgacgacagaggacatgctgagcgtctggaatcgggtgtggatcgaagagaacccctggatggaagataagacccacgtttcctcttgggaggaggtgccctaccttgggaagagagaagaccagtggtgcggaagcctgattggcctcaccgcccgcgctacatgggccaccaatatccaggtcgcgattaaccaagtgcggagactgatcgggaatgagaactatctggactacatgacatccatgaaacgctttaagaatgaaagcgatcctgagggcgctctctggtga

SEQ ID NO: 18459 - RNA, 9879 nt, synthetic construct
  misc_feature 1..9879: note = derived and/or modified CDS sequence (opt5) from DENV-1__JX669463__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttttggcgggcctatcagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagattatccatgagtggtgttgcagaagctgtacactgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgaccggaacactcgctgtgttcctgcttctgatcatgggccagctcacctggaacgacctgattcggctgtgcatcatggtcggcgccaatgcctccgaccgcatggggatgggaaccacataccttgctctgatggccacgctcaagatgagacctatgtttgcggtgggcctgctcttccggcgcctgacctctagagaagtgcttctgctcacaattgggctgagcctggtcgcttccgttgagcttcccaactctctggaagagctcggagatggcctggccatggggatcatgatgctcaagctgcttaccgaatttcaaccccaccagctgtggacaaccctcctgagcctgacgttcgtgaaaacaaccctttccctggactatgcctggaagaccacagctatggtgctcagcattgtctctctgtttcctctctgtctgtccaccacaagccagaaaacgacctggcttccggtgctgctgggatctttcggctgcaagcccctcacaatgtttctgatcaccgagaacaaaatctggggccggaagtcctggcctcttaatgaggggattatggccatcggaattgttagcatcctgctctcttccctgctcaagaacgatgtgcccctggctggccctcttattgccgggggaatgctgatcgcgtgttacgtcatcagcggctccagcgccgacctgtctctcgaaaaagctgccgaggtgagctgggaacaggaggctgaacattccggggcctctcacaatattctggttgaggtgcaagatgacggaacaatgaagatcaaagatgaggaacgcgacgatacccttacgattctgctcaaggccaccctgctcgctgtcagcggcgtgtatcccatgtccatccctgcgacactgttcgtctggtacttctggcagaaaaagaaacagagatctggcgtgctttgggacacccccagcccgcctgaggttgaacgggccgtgctggatgacgggatttatcgcatcctgcagagaggactcctgggccggtcccaagtcggggtgggagtttttcaggatggcgtgttccatacaatgtggcacgtcaccagaggggctgtgcttatgtaccagggaaagcgcctggagccctcttgggccagcgtgaagaaagacctcatctcctatggcggcgggtggcggtttcagggaagctggaacacaggcgaggaagttcaagtcattgccgtggagcctgggaagaatcccaaaaacgtgcagacgaccccgggaacattcaagacccctgaaggcgaggtcggggctatcgccctggactttaaacccggaacctctggctcccctattgtgaatagagaaggcaagatcgttgggctctacggaaacggcgtggtcacaacgagcgggacctacgtgtctgcgattgctcaggccaaggcctcccaagagggacccctgcccgagatcgaagatgaggttttcaaaaagcgcaatcttacaattatggacctgcaccctggcagcgggaaaacccggagatatctgccggctatcgtgcgcgaagccatcaagcggaaactcagaacactgattcttgcgcccacccgcgtcgtggcttccgagatggccgaagccctgaagggcatgcctatccggtaccagacgacagctgttaagtctgagcataccggaagagagattgtggatctcatgtgccacgccacctttacaatgcggctgctgagccccgtccgcgtgcctaactataatatgatcattatggacgaagctcatttcaccgatcccgcctccatcgcggccagaggctacatcagcacacgggtggggatgggagaggctgccgctatttttatgaccgccacgcctccgggctctgtcgaagccttcccccagtccaacgctgttatccaggacgaggaacgcgatattcctgagagaagctggaattctgggtatgactggatcacagattttcccggaaaaaccgtgtggttcgtgcctagcattaagtccggcaacgacatcgcgaattgtctccggaaaaacgggaagagagtcatccaactttctcgcaaaacattcgataccgagtaccagaagacgaagaacaatgactgggactatgtggttaccacagatattagcgaaatgggcgccaactttcgggctgacagagtgatcgatccccgccggtgcctgaaaccggtcattctgaaggacggacctgagagagtgatcctcgccggccccatgcccgttaccgtggcctccgctgcccagcgccgggggagaattggacgcaatcagaacaaagaaggcgatcaatacatctacatggggcagcctctgaataacgacgaggatcacgcgcattggacagaggctaagatgcttctggacaatattaacacccccgaaggaatcatccctgccctcttcgagccggaaagagagaaatctgccgctattgatggcgaatatcggctgcgcggggaggccagaaagacatttgtcgagctgatgcggcgcggcgacctccccgtgtggcttagctacaaggtcgcgtccgaaggattccagtatagcgatagacggtggtgctttgacggcgagagaaataaccaggtgctggaagagaatatggatgttgaaatctggaccaaagagggggagcgcaagaaactgcggcctagatggctcgacgcccgcacgtactctgaccccctggctcttcgggaattcaaggagtttgccgctggaagacggtccgtgagcggcgatctgattctcgaaatcgggaaactgcctcaacacctgacactccgcgcccagaacgctcttgacaatctggtgatgctgcacaactccgagcagggaggcaaggcctatagacatgcgatggaagagctccccgataccattgagaccctgatgcttctggccctcatcgctgtcctgacaggcggggttaccctgttctttctctctggaaaaggccttgggaagacaagcatcggactgctgtgtgtgacggcctcctctgctctcctgtggatggccagcgtggaaccgcactggattgccgcttccatcattcttgagttctttctgatggtcctcctgatccctgaacccgaccggcagcgcacccctcaagataatcagctggcgtacgtggttattggcctccttttcatgatcctgacagtggccgctaacgagatggggctgctcgagaccacaaagaaagacctgggaatcggctatgtcgccgccgaaaaccatcagcacgctaccatgcttgatgtggacctgcaccccgccagcgcgtggacgctctacgccgtcgctaccacagtgattacccctatgatgagacatacaatcgagaataccacggccaacatttctctgacagctatcgccaatcaagcggccattctgatgggcctcgataaggggtggcccatctccaaaatggacattggagttccgcttctggctctgggctgctacagccaggtgaaccctctcaccctgacagccgctgtccttatgctggtggcccactatgctatcatcgggcccggactccaggccaaggcgacccgggaagcccagaaacgcaccgctgccggcattatgaagaatcccacagttgatgggatcgtggctattgacctggatcctgtcgtgtacgacgccaagtttgagaaacaactgggacagatcatgctccttattctgtgtacgtctcagatcctgctcatgagaaccacatgggccctgtgcgaatccatcacccttgcgacaggcccgctgaccacgctctgggagggcagccccgggaagttctggaacacaaccattgctgtgtctatggccaatatcttccggggaagctatctggctggcgccgggctggccttttccctcatgaaatctcttggaggcgggcgcagaggaaccggcgctcagggcgagacactgggggaaaagtggaaacggcaactgaaccagctcagcaagtccgagttcaatacctacaagagaagcggaattatggaagttgaccgctccgaggccaaagaaggcctgaagcggggggagacaacgaaacatgcggtctctagaggaaccgccaagcttcgctggtttgtggagcggaacctggtgaaacctgaaggcaaggtcatcgatctcgggtgtggaagaggcggctggagctattactgcgctgggctgaagaaagttacagaggtgaagggatataccaaaggcgggcccggacacgaagagcctattcccatggccacatacggctggaatctggtgaagctccattccgggaaagacgtcttctttatgcctccggaaaagtgtgatacccttctgtgcgacatcggagagtctagccccaaccctacgatcgaggaaggccgcaccctgcgggtgctcaaaatggttgagccctggctgagaggcaatcagttctgtattaagatccttaacccttacatgccctccgtggtcgaaacactggagcagatgcaacgcaagcacgggggaatgctcgtgcggaatccgctgtctagaaacagcacccacgagatgtattgggtttcctgcggcacagggaatattgtgagcgctgtcaacatgacctctcgcatgctgctcaaccggtttacaatggcccatagaaaacctacctacgaacgcgatgtggacctgggagcgggcacgagacacgtggccgtcgagcccgaagttgctaatcttgatatcattgggcagcggatcgagaacattaagaatgaacataaatccacatggcactatgacgaggataacccctacaagacctgggcctatcacggaagctacgaggtgaaaccttctggctccgctagctctatggtgaatggcgtcgtgcgcctgctcaccaagccctgggacgttatccctatggtgacacagatcgccatgacggataccacaccgttcgggcaacagagagtctttaaggaaaaagtggacacccggacacccagagctaagcggggaaccacacagattatggaggttaccgccaaatggctgtggggcttcctttcccgcaacaagaaacctagaatctgtacgcgggaagagtttacccgcaaggtgagaagcaatgcggccattggggctgtcttcgtggacgaaaaccagtggaattccgccaaggaggctgttgaggatgaacggttttgggacctggtgcatcgcgagagagaactccacaaacaaggaaagtgcgccacatgcgtctataacatgatgggcaaacgggagaagaaactgggggaattcggcaaggccaagggaagccgcgcgatctggtacatgtggctgggcgctagattcctcgagtttgaggccctggggttcatgaatgaagatcattggttttctcgggagaacagcctttccggagtggaaggcgaggggctgcacaaactcggatacattctgcgcgacatctctaagatccccggcgggaatatgtatgccgatgacaccgctggctgggatacaagaattaccgaggacgatcttcagaacgaagccaaaatcacggacattatggagcctgaacatgctctgctcgccacaagcatcttcaagctgacctaccagaataaagtcgtgcgggttcagcgccccgcgaagaacggaacagtgatggatgtcatttccagacgggaccaaagaggctctgggcaggtgggaacctatggcctgaacacgtttaccaatatggaggtgcagctcatccgccagatggaaagcgaggggatcttcctgccgtccgagcttgaaacacctaacctggccgagcgggctctcgattggctggaaaaacacggagccgagagacttaagcgcatggctatttctggcgacgactgtgttgtgaagcccatcgatgaccggtttgccaccgcgctgacagccctcaatgatatggggaaagtcagaaaggacattcctcaatgggaacccagcaaaggctggaacgattggcagcaggtgcctttctgctcccaccattttcaccagctgatcatgaaggacggacgcgagattgttgtgccctgtcggaatcaagatgagctggtcggcagagctcgcgtgagccagggggccggatggtctctccgggaaaccgcttgcctgggcaaatcctacgcccagatgtggcaacttatgtatttccatagacgcgacctgcggctcgctgccaacgcgatctgtagcgccgtcccggtggattgggttcctgcttctagaacaacctggtccatccacgcccaccatcagtggatgacgacagaggacatgctgagcgtgtggaatcgggtctggattgaagagaacccctggatggaagataagacccacgtgtcctcttgggaggaggttccctaccttgggaagagagaagaccagtggtgcggaagcctgatcggcctcaccgcccgcgctacatgggccaccaatattcaggtggcgatcaaccaagtccggagactgattgggaatgagaactatctggactacatgacatccatgaaacgctttaagaatgaaagcgatcctgagggcgctctctggtga

SEQ ID NO: 18460 - RNA, 9879 nt, synthetic construct
  misc_feature 1..9879: note = derived and/or modified CDS sequence (opt5) from DENV-1__JX669464__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattctcacacacagatgtgcgaccaccgcctgatgagcgccgctattaaggattccaaagcggttcatgccgacatgggctattggatcgaaagcgagaagaatgaaacctggaagctcgctcgggcctctttcatcgaggtgaaaacatgtatttggcccaagtcccacaccctgtggagcaacggggtgcttgaatctgagatggtcatcccgaaaatttacggaggccctatctcccaacataattatagacccgggtacttcacacagaccgccggaccttggcacctgggcaagctcgagctggattttgacctgtgcgaagggacgaccgtggttgtggatgagcactgcggataccgcggccccagccttcggacaaccacagtcaccggcaaaattatccatgaatggtgttgcagatcttgtacgctccctcccctgcggttccgcggggaggacggatgctggtatggcatggagatcagaccggtgaaggaaaaggaggaaaacctggttcggagcatggtgtccgctgggagcggagagatggactctttttccctcggcattctgtgtgtcagcatccttattgaagaggtgatgagatcccgctggtctcggaaaatgctgatgacagggaccctcgccgttttcctgctgcttatcatgggacagctgacatggaatgatctcattagactgtgcatcatggtgggcgcgaacgctagcgaccgcatgggcatggggaccacctacctcgccctgatggccacatttaagatgagacctatgttcgctgtcggacttctgtttcggcgcctcacgtccagagaggtgctgctgcttaccgtgggcctgtctctcgtcgccagcgttgaactgcccaattccctcgaggaactgggggatggacttgcgatgggcattatgatgctgaaactcctgacagacttccaaccccaccagctgtggaccacacttctgtctctcacctttatccggacgagcctgtccctcgattatgcttggaagacaatggccatggccctgagcatcgtgtctcttttccctctgtgtctgtccaccaccagccagaaaacaacctggctcccggtgctgcttgggtcttttggatgcaagcccctgacaatgttcctcattacggagaacaagatctggggccgcaaatcctggcctattaacgaaggcatcatggctgtcgggattgtgagcatcctgctctcttccctgcttaagaatgacgttcccctggccggacctctgatcgctggcgggatgctcattgcctgttacgtgatcagcggatccagcgcggatctgtctcttgagaaagccgctgaggtcagctgggaagaggaagccgagcattccggcacctctcacaacattctggtggaagttcaggacgatgggacaatgaagatcaaagacgaggagagagatgacaccctcacaattctgctcaaggctaccctgcttgccgtgagcggagtctatcccatgtccatccctgccacgctgtttgtgtggtacttctggcaaaaaaagaagcagcggtctggcgtcctgtgggatacccccagcccgcctgaagtggagcgcgctgttctcgacgacggcatctatagaattctgcagcgggggcttctgggacgctcccaggtgggcgtcggggtgttccaagatggagtttttcatacaatgtggcacgtgaccagaggcgcggtcctcatgtaccaggggaaacggctggaaccctcttgggccagcgtgaagaaagacctcatctcctacggaggcggctggagattccaggggagctggaatacaggagaggaggtgcaggttattgctgtcgaacctggcaagaaccccaaaaatgtgcaaaccacaccggggacgtttaagatccctgagggagaagtgggcgccattgccctggatttcaagcccgggacctctggatcccctatcgtcaaccgcgagggcaaaattgtgggcctttatgggaatggagttgtgacaaccagcggcacctacgtctctgctatcgcccaggcgaaggctacacaggaagggcccctgcccgagatcgaggacgaagtgtttaaaaagcggaacctgacgattatggatctccaccctggatccggcaaaaccagacgctatctgccggccatcgttcgggaggccattaagagaaagcttcgcacactgatcctcgctcccacccgggtggtcgccagcgaaatggcggaggctctgaaagggatgcctattagataccaaacaaccgccgtgaagtccgaacatacgggccgcgagatcgttgacctgatgtgccacgccacattcaccatgcggctcctttctcccgtgagagtccctaattataacatgatcattatggatgaggctcattttaccgaccccgccagcatcgctgcccggggatacatttccacacgcgtgggcatgggggaagcggccgctatcttcatgaccgccacacctccgggaagcgtggaggcttttccccagtctaatgccgtcattcaggatgaagagagagacatccctgaacggtcctggaacagcggctatgattggatcaccgacttccccgggaaaacggtttggtttgtgccttctattaagagcggaaatgacatcgccaactgtctgcgcaaaaatggcaagagagtgattcagctgtcccggaagacattcgataccgagtaccaaaaaacaaagaacaacgactgggattacgtcgtgaccacggacatctctgagatgggggctaatttcagagcggatcgcgttattgacccccggagatgcctcaaaccggtgatcctgaaggaaggccctgagcgcgtcattcttgccggacccatgcccgtgaccgttgctagcgccgcccagcggagaggccgcatcgggcggaaccagaataaagaaggagatcagtatatctacatgggccaacctctgaacaatgacgaggatcacgctcattggacagaggccaagatgctcctggacaacattaatacccccgaagggatcattcctgcgctgtttgagccggaaagagagaagtccgctgccatcgatggagaatatcgcctcagaggcgaggcccggaaaacattcgtggagcttatgcgcagaggggacctgcccgtctggctgtcttacaaggtggctagcgaaggctttcagtattccgatcggcgctggtgcttcgacggagagagaaacaatcaggtcctcgaagagaacatggacgtggaaatttggaccaaagagggcgagcggaagaaactgagacctcgctggcttgatgcccggacatacagcgaccccctggcgctcagagaatttaaggagttcgccgctgggcgccggtctgtttccggagatctgatcctggaaatcggcaaactccctcagcaccttaccctgagagcccaaaatgctctggacaacctcgtgatgctgcacaatagcgagcaggggggaaaggcctatcggcatgctatggaagagcttcccgatacgattgagacactgatgctcctggccctgatcgcggtgctcaccggcggcgtcaccctttttttcctgtccgggaagggactgggcaaaacatctattgggctcctgtgtgttatggccagctccgctcttctgtggatggcctctgtggaaccgcactggatcgctgccagcattatcctcgagtttttcctgatggtgctgctcatccctgaacccgaccgccagagaacccctcaggataaccaacttgcctacgtcgtgattggactgctgtttatgatcctcacagttgctgcgaatgagatgggcctgcttgagacgaccaagaaagacctggggattggacatgtggccgtcgaaaaccaccaccatgctacaatgctcgatgtggacctgcggcccgcctccgcctggaccctgtacgctgtcgccacaaccgtgatcacgcctatgatgcgccacaccattgagaacacaaccgcgaatatcagcctcacagccattgctaaccaggccgctatccttatgggcctggataagggctggcccatctctaaaatggacattggggttccgctgctcgccctgggatgctattcccaggtgaatcctcttaccctgacggcggccgtcctcatgctggtggctcattacgccatcattggccccgggctgcaagctaaggccacaagagaagctcagaagcggaccgccgcgggaatcatgaaaaaccccacagttgatggcattgtgaccatcgacctcgaccctgtcgtgtatgatgccaagttcgagaaacagcttgggcagatcatgctgctgattctctgtaccagccaaatcctgcttatgcgcacaacgtgggctctgtgcgaatctattaccctcgccacaggaccgctgaccacactgtgggagggctcccccggcaagttttggaataccacgatcgctgtgagcatggccaacattttcagagggtcttacctcgccggagcgggccttgctttcagcctgatgaaatccctggggggaggccggcgcgggacaggagcccagggcgagaccctcggcgaaaagtggaagagacagctgaatcagctttctaaaagcgagtttaacacctataagaaatccgggatcatggaagttgaccggagcgaggctaaggaaggactgaaaagaggcgagacaaccaagcacgccgtctcccgcgggacagccaagctccggtggttcgtggagagaaatctggtgaaacctgaaggaaaggtcatcgatctgggctgtgggcgcggaggctggtcttactattgcgctggcctcaaaaaggttacggaggtgaaagggtacaccaagggaggccccgggcatgaagagcctattcccatggccacatacggatggaaccttgtgaaactgcacagcggcaaggacgtctttttcacccctccggaaaagtgtgatacactgctctgcgacatcggggagtcctctcccaatcctaccattgaggaaggacggacgctgagagtgcttaaaatggttgagccctggctgcgcggcaaccaattttgtatcaagattctcaatccttatatgcccagcgtggtcgaaaccctggagcagatgcagcggaaacacggcgggatgctggtgagaaacccgctctcccgcaattctacacatgagatgtactgggttagctgcggaaccggcaacatcgtgtccgcggtcaatatgacaagccggatgctgcttaacagattcaccatggcccaccgcaagcctacatatgaacgggatgtggacctgggggctggaaccagacatgtggccgtcgagcccgaagttgctaacctcgatattatcggccagcgcatcgagaatattaaaaacgaacacaagtctacgtggcactacgacgaggataatccctataagacatgggcctaccatgggtcctatgaggtgaaacctagcggatctgcgtccagcatggtgaacggcgtcgtgagactgcttaccaagccctgggacgttatccctatggtgacccaaattgccatgacagacacgaccccgtttggccagcagcgggtcttcaaagaaaaggtggatacacgcacccccagagctaaacgggggacagcccaaatcatggaggttaccgctaagtggctgtggggatttctctctagaaataagaaacctcggatttgtacacgcgaagagttcaccagaaaggtgcggtccaacgccgctatcggcgccgtctttgtggacgaaaatcagtggaacagcgcgaaagaggccgttgaggatgaacgcttctgggacctggtgcacagagagcgggaactgcataagcaggggaaatgcgctacgtgcgtctacaatatgatgggaaagcgcgagaagaaactcggcgaatttgggaaggccaaaggctccagagctatctggtacatgtggctgggagcccggttccttgagttcgaggccctgggctttatgaacgaagatcactggttcagccgcgagaattctctcagcggggtggaaggagagggcctgcataagcttgggtatattctgagagacatctccaaaattcccggaggcaacatgtacgcggatgacaccgctgggtgggatacacggatcaccgaggacgatctccagaatgaagccaagattacagacatcatggagcctgaacacgccctgctggctacctctatctttaaactcacgtatcaaaacaaggtcgtgcgcgttcagagacccgccaagagcggcacagtgatggatgtcatttcccggcgcgaccagagaggatctggccaggtggggacctacggactgaatacattcaccaacatggaggtgcaacttatccggcagatggaaagcgagggcatttttctgccgtccgagctcgaaacgcctaacctggctaaaaaggttcttgactggctggagaaacacggggccgaaagactcaagcgcatggcgatctctggagatgactgtgtggtcaaacccattgatgaccggttcgccaccgctctgacagccctgaatgatatgggcaaggtgagaaaggacatccctcagtgggagcccagcaaagggtggaacgattggcagcaagttcctttttgctcccatcacttccatcagctcatcatgaaggacggccgcgaaattgtggtcccctgtcggaatcaggatgagctggtgggaagagctcgcgtcagccagggcgccgggtggtctcttcgggagaccgcgtgcctgggaaaatcctatgcccaaatgtggcagctcatgtactttcacagacgcgacctgcggcttgctgccaacgctatctgtagcgccgtgccggttgattgggtgcctacatctagaaccacatggtccattcacgctcatcaccagtggatgaccacggaagacatgctgagcgtctggaatcgcgtgtggatcgaggaaaacccctggatggaggacaagacacatgtttcctcttgggaagaggtgccctatctcggcaaacgggaggatcaatggtgcgggagcctgattggactgaccgccagagcgacctgggccacaaatatccaggtcgctattaaccaggtgcggagactcatcggcaatgaaaactacctggactacatgacctccatgaagcgcttcaagaatgagagcgatcctgaaggggccctttggtga

SEQ ID NO: 18461 - RNA, 9879 nt, synthetic construct
  misc_feature 1..9879: note = derived and/or modified CDS sequence (opt5) from DENV-1__JX669465__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatacccagaacaccacatttatcatcgacgggcctgatacccccgaatgtcctgacgatcagcgggcctggaatatttgggaggtcgaggactacggattcggcatctttacgacaaacatttggctcaaactgagagattctcacacccagatgtgcgaccaccgcctgatgagcgccgctatcaaggattccaaagcggttcatgccgacatgggctattggattgaaagcgagaagaatgaaacatggaagctcgctcgggcctctttcatcgaggtgaaaacctgtatctggcccaagtcccacacactgtggagcaacggggtgcttgaatctgagatggtcattccgaaaacctacggaggccctatctcccaacataattatagacccgggtacttcacgcagaccgccggaccttggcacctgggcaagctcgagctggattttgacctgtgcgaagggacaaccgtggttgtggatgagcactgcggataccgcggccccagccttcggacaaccacggtcacaggcaaaattatccatgaatggtgttgcagatcttgtaccctccctcccctgcggttccgcggggaggacggatgctggtatggcatggagattagaccggtgaaggaaaaggaggaaaacctggttcggagcatggtgtccgctgggagcggagagatggactctttttccctcggcatcctgtgtgtcagcatccttattgaagaggtgatgagatcccgctggtctcggaaaatgctgatgacagggaccctcgccgttttcctgctgcttatcatgggacagctgacctggaatgatctcattagactgtgcatcatggtgggcgcgaacgctagcgaccgcatgggcatggggacaacgtacctcgccctgatggccacctttaagatgagacctatgttcgctgtcggacttctgtttcggcgcctcacatccagagaggtgctgctgcttaccgtgggcctgtctctcgtcgccagcgttgaactgcccaattccctcgaggaactgggggatggacttgcgatgggcattatgatgctgaaactcctgacagacttccaaccccaccagctgtggaccacgcttctgtctctcacatttatccggaccagcctgtccctcgattatgcttggaagaccatggccatggccctgagcattgtgtctcttttccctctgtgtctgtccacaaccagccagaaaacaacgtggctcccggtgctgcttgggtcttttggatgcaagcccctgaccatgttcctcatcacagagaacaagatctggggccgcaaatcctggcctattaacgaaggcatcatggctgtcgggattgtgagcatcctgctctcttccctgcttaagaatgacgttcccctggccggacctctgattgctggcgggatgctcatcgcctgttacgtgatcagcggatccagcgcggatctgtctcttgagaaagccgctgaggtcagctgggaagaggaagccgagcattccggcacctctcacaacattctggtggaagttcaggacgatgggacaatgaagatcaaagacgaggagagagatgacaccctcacgattctgctcaaggctaccctgcttgccgtgagcggagtctatcccatgtccatccctgccacactgtttgtgtggtacttctggcaaaaaaagaagcagcggtctggcgtcctgtgggatacccccagcccgcctgaagtggagcgcgctgttctcgacgacggcatttatagaatcctgcagcgggggcttctgggacgctcccaggtgggcgtcggggtgttccaagatggagtttttcatacaatgtggcacgtgaccagaggcgcggtcctcatgtaccaggggaaacggctggaaccctcttgggccagcgtgaagaaagacctcatctcctacggaggcggctggagattccaggggagctggaatacaggagaggaggtgcaggttattgctgtcgaacctggcaagaaccccaaaaatgtgcaaacgaccccggggacatttaagacccctgagggagaagtgggcgccatcgccctggatttcaagcccgggacctctggatcccctattgtcaaccgcgagggcaaaatcgtgggcctttatgggaatggagttgtgacaacgagcggcacctacgtctctgctattgcccaggcgaaggctacacaggaagggcccctgcccgagatcgaggacgaagtgtttaaaaagcggaacctgaccattatggatctccaccctggatccggcaaaacaagacgctatctgccggccatcgttcgggaggccatcaagagaaagcttcgcaccctgattctcgctcccacgcgggtggtcgccagcgaaatggcggaggctctgaaagggatgcctatcagataccaaacaaccgccgtgaagtccgaacataccggccgcgagattgttgacctgatgtgccacgccacattcaccatgcggctcctttctcccgtgagagtccctaattataacatgatcattatggatgaggctcattttacagaccccgccagcatcgctgcccggggatacatctccacccgcgtgggcatgggggaagcggccgctattttcatgacggccacacctccgggaagcgtggaggcttttccccagtctaatgccgtcatccaggatgaagagagagacattcctgaacggtcctggaacagcggctatgattggatcaccgacttccccgggaaaacagtttggtttgtgccttctattaagagcggaaatgacatcgccaactgtctgcgcaaaaatggcaagagagtgatccagctgtcccggaagaccttcgatacggagtaccaaaaaaccaagaacaacgactgggattacgtcgtgacaaccgacatttctgagatgggggctaatttcagagcggatcgcgttatcgacccccggagatgcctcaaaccggtgattctgaaggaaggccctgagcgcgtcatccttgccggacccatgcccgtgacagttgctagcgccgcccagcggagaggccgcattgggcggaaccagaataaagaaggagatcagtatatctacatgggccaacctctgaacaatgacgaggatcacgctcattggaccgaggccaagatgctcctggacaacattaatacacccgaagggatcatccctgcgctgtttgagccggaaagagagaagtccgctgccattgatggagaatatcgcctcagaggcgaggcccggaaaaccttcgtggagcttatgcgcagaggggacctgcccgtctggctgtcttacaaggtggctagcgaaggctttcagtattccgatcggcgctggtgcttcgacggagagagaaacaatcaggtcctcgaagagaacatggacgtggaaatctggacgaaagagggcgagcggaagaaactgagacctcgctggcttgatgcccggacatacagcgaccccctggcgctcagagaatttaaggagttcgccgctgggcgccggtctgtttccggagatctgattctggaaatcggcaaactccctcagcaccttaccctgagagcccaaaatgctctggacaacctcgtgatgctgcacaatagcgagcaggggggaaaggcctatcggcatgctatggaagagcttcccgataccattgagacactgatgctcctggccctgatcgcggtgctcaccggcggcgtcacactttttttcctgtccgggaagggactgggcaaaacgtctatcgggctcctgtgtgttatggccagctccgctcttctgtggatggcctctgtggaaccgcactggattgctgccagcatcattctcgagtttttcctgatggtgctgctcatccctgaacccgaccgccagagaacccctcaggataaccaacttgcctacgtcgtgattggactgctgtttatgatcctcacagttgctgcgaatgagatgggcctgcttgagaccacaaagaaagacctggggatcggacatgtggccgtcgaaaaccaccaccatgctaccatgctcgatgtggacctgcggcccgcctccgcctggacgctgtacgctgtcgccaccacagtgattacccctatgatgcgccacacaatcgagaacaccacggcgaatattagcctcacagccatcgctaaccaggccgctattcttatgggcctggataagggctggcccatctctaaaatggacattggggttccgctgctcgccctgggatgctattcccaggtgaatcctcttaccctgacagcggccgtcctcatgctggtggctcattacgccatcatcggccccgggctgcaagctaaggccaccagagaagctcagaagcggaccgccgcgggaattatgaaaaaccccacagttgatggcatcgtgacgattgacctcgaccctgtcgtgtatgatgccaagttcgagaaacagcttgggcagatcatgctgctgattctctgtaccagccaaatcctgcttatgcgcacaacctgggctctgtgcgaatctatcacactcgccaccggaccgctgacgacactgtgggagggctcccccggcaagttttggaataccaccattgctgtgagcatggccaacatcttcagagggtcttacctcgccggagcgggccttgctttcagcctgatgaaatccctggggggaggccggcgcgggacaggagcccagggcgagaccctcggcgaaaagtggaagagacagctgaatcagctttctaaaagcgagtttaacacatataagaaatccgggattatggaagttgaccggagcgaggctaaggaaggactgaaaagaggcgagacgaccaagcacgccgtctcccgcgggacagccaagctccggtggttcgtggagagaaatctggtgaaacctgaaggaaaggtcatcgatctgggctgtgggcgcggaggctggtcttactattgcgctggcctcaaaaaggttaccgaggtgaaagggtacacaaagggaggccccgggcatgaagagcctattcccatggccacctacggatggaaccttgtgaaactgcacagcggcaaggacgtctttttcacgcctccggaaaagtgtgataccctgctctgcgacatcggggagtcctctcccaatcctacaatcgaggaaggacggaccctgagagtgcttaaaatggttgagccctggctgcgcggcaaccaattttgtattaagatcctcaatccttatatgcccagcgtggtcgaaacactggagcagatgcagcggaaacacggcgggatgctggtgagaaacccgctctcccgcaattctacccatgagatgtactgggttagctgcggaacaggcaacattgtgtccgcggtcaatatgaccagccggatgctgcttaacagattcacgatggcccaccgcaagcctacatatgaacgggatgtggacctgggggctggaaccagacatgtggccgtcgagcccgaagttgctaacctcgatatcattggccagcgcatcgagaatattaaaaacgaacacaagtctacctggcactacgacgaggataatccctataagacatgggcctaccatgggtcctatgaggtgaaacctagcggatctgcgtccagcatggtgaacggcgtcgtgagactgcttacgaagccctgggacgttatccctatggtgacccaaatcgccatgacagacaccacaccgtttggccagcagcgggtcttcaaagaaaaggtggatacccgcacacccagagctaaacgggggaccgcccaaattatggaggttacggctaagtggctgtggggatttctctctagaaataagaaacctcggatctgtacccgcgaagagttcacaagaaaggtgcggtccaacgccgctattggcgccgtctttgtggacgaaaatcagtggaacagcgcgaaagaggccgttgaggatgaacgcttctgggacctggtgcacagagagcgggaactgcataagcaggggaaatgcgctacctgcgtctacaatatgatgggaaagcgcgagaagaaactcggcgaatttgggaaggccaaaggctccagagctatctggtacatgtggctgggagcccggttccttgagttcgaggccctgggctttatgaacgaagatcactggttcagccgcgagaattctctcagcggggtggaaggagagggcctgcataagcttgggtatattctgagagacatctccaaaatccccggaggcaacatgtacgcggatgacacagctgggtgggatacccggattacggaggacgatctccagaatgaagccaagatcacagacattatggagcctgaacacgccctgctggctacctctatctttaaactcacatatcaaaacaaggtcgtgcgcgttcagagacccgccaagagcggcaccgtgatggatgtcatttcccggcgcgaccagagaggatctggccaggtggggacgtacggactgaataccttcacaaacatggaggtgcaacttatccggcagatggaaagcgagggcatcttttccccgtctgagctggaaacccctaacctcgctaaaaaggttctggactggcttgagaaacacggggccgaaagactgaagcgcatggcgattagcggagatgactgtgtggtcaaacccatcgatgaccggttcgccacagctctcaccgccctgaatgatatgggcaagattagaaaggacatccctcagtgggagccctccaaagggtggaacgattggcagcaagtgcctttttgcagccatcacttccatcagctgattatgaaggacggccgcgaaatcgttgtgccctgtcggaatcaggatgagctcgtcggaagagctcgcgtgtctcagggcgccgggtggtccctgcgggagacagcgtgccttggaaaaagctatgcccaaatgtggcagctgatgtactttcacagacgcgacctccggctggctgccaacgctatctgttctgccgtcccggtggattgggttcctacctccagaacgacatggagcattcacgctcatcaccagtggatgaccaccgaagacatgctttccgtgtggaatcgcgtctggatcgaggaaaacccctggatggaggacaagacacatgtgtctagctgggaagaggttccctatctgggcaaacgggaggatcaatggtgcgggtccctcattggactgaccgccagagcgacatgggccacgaatatccaggtggctattaaccaggtccggagactgatcggcaatgaaaactacctcgactacatgaccagcatgaagcgcttcaagaatgagtctgatcctgaaggggccctgtggtga

SEQ ID NO: 18462 - RNA, 9879 nt, synthetic construct
  misc_feature 1..9879: note = derived and/or modified CDS sequence (opt5) from DENV-1__JX669466__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccattctggtgcaggttaagtacgaaggcaccgacgcgccgtgcaagatccctttttctacacaagatgagaaaggggtgacccagaacggaagacttatcacagctaatcccattgtcacggacaaggaaaaacctgtgaacatcgagaccgagccccccttcggcgaatcctatattgtggttggggccggagagaaggccctcaaactgagctggtttaagcgcggctctagcatcgggaagatgttcgaagctacagcccggggcgctagacgcatggccattctgggagataccgcgtgggactttggctccatcgggggagtcttcacatctgtgggcaaactcgtgcatcaggtctttgggaccgcctacggagtgctgttcagcggcgtttcctggacgatgaagatcgggattggcatccttctgacctggctcggactgaatagccggtctacatccctgagcatgacctgtattgctgtgggcatggtcacactttacctcggggtgatggttcaggccgatctgggatgcgtgatcaactggaaaggcagagagctgaagtgtgggtctggaatttttgtcaccaacgaagtgcacacatggaccgagcaatataaattccaggctgactcccctaagcgcctcagcgccgcgatcggcaaggcctgggaggaaggggtttgcggcattcggtccgctacgagactggagaatatcatgtggaaacagatctctaacgaacttaatcatattctgctcgagaacgatatgaagtttacagtggtcgtgggagacgccaatggcatcctggctcaggggaaaaagatgattcgcccgcaacccatggaacacaaatacagctggaagtcctggggaaaagccaagatcattggcgccgacatccagaacaccaccttcatcattgatgggcctgacacacccgagtgtcctgatggacagcgggcttggaatatctgggaggtggaagactatggctttggcgtcttcaccacgaacatttggctgaagcttagagattcttacacacagatgtgcgaccaccgcctcatgagcgcggccatcaaagattccaaggctgttcatgccgacatggggtattggattgagagcgaaaaaaatgagacctggaagctggcccgggcttctttcatcgaagtgaaaacatgtacctggcccaagtcccacacactgtggagcaacggagtgctcgagtctgagatgatcattccgaagatctttggcgggcctatttcccaacataattacagacccggatatttcacccagacggccggcccttggcacctggggaaacttgaactggattttgacctctgcgagggaaccacagtcgtggttgatgaacactgcggcaaccggggccccagcctgcgcaccacaaccgtgacggggaagatcattcatgagtggtgttgcagatcttgtacactgcctccccttcggttcagaggagaggacggctgctggtacgggatggaaatccgcccggtcaaagagaaggaagagaatctcgtgcggagcatggtttccgcgggaagcggcgaagtggattctttttccctggggatcctgtgtgtcagcattatgatcgaggaggtgatgagatcccgctggtctagaaaaatgctcatgaccggaacactggctgttttccttctgctcattatgggccagctgacctggaacgacctgatccggctttgcattatggtgggcgccaatgccagcgaccgcatggggatgggaaccacatacctggctctcatggccacgtttaagatgagacctatgttcgcggtcggcctgctctttcggcgcctgacctccagagaagtgcttctgctcacaatcgggctgtctctggtggctagcgtcgagcttcccaactccctggaagagctcggagatggcctggccatggggattatgatgctcaagctgcttaccgaattccaaccccaccagctgtggacaaccctcctgtctctgacgtttgttaaaacaacccttagcctggactatgcctggaagaccacagctatggtgctctccatcgtgagcctgttccctctctgtctgtctaccacatcccagaaaacgacctggcttccggtcctgctgggaagctttggctgcaagcccctcacaatgttcctgatcaccgagaacaaaatttggggccggaagtcttggcctcttaatgaggggatcatggccattggaatcgtgtccattctgctcagctctctgctcaagaacgatgttcccctggctggccctcttatcgccgggggaatgctgatcgcgtgttacgtgatttccggcagctccgccgacctgagcctcgaaaaagctgccgaggtctcttgggaacaggaggctgaacatagcggggcctcccacaatatcctggtggaggttcaagatgacggaacaatgaagattaaagatgaggaacgcgacgatacccttacgatcctgctcaaggccaccctgctcgctgtgtctggcgtctatcccatgagcattcctgcgacactgttcgtgtggtacttttggcagaaaaagaaacagagatccggcgtcctttgggacaccccctctccgcctgaggtggaacgggccgttctggatgacgggatctatcgcatcctgcagagaggactcctgggccggagccaagtgggggtcggagtgttccaggatggcgtttttcatacaatgtggcacgtgaccagaggggctgtccttatgtaccagggaaagcgcctggagccctcctgggcctctgtgaagaaagacctcattagctatggcggcgggtggcggttccagggatcctggaacacaggcgaggaagtgcaagttatcgccgtcgagcctgggaagaatcccaaaaacgtgcagacgaccccgggaacatttaagacccctgaaggcgaggtgggggctattgccctggacttcaaacccggaaccagcggctctcctatcgtcaatagagaaggcaagattgtggggctctacggaaacggcgttgtgacaacgtccgggacctacgtcagcgcgatcgctcaggccaaggcctctcaagagggacccctgcccgagattgaagatgaggtgtttaaaaagcgcaatcttacaatcatggacctgcaccctggctccgggaaaacccggagatatctgccggctatcgttcgcgaagccattaagcggaaactcagaacactgatccttgcgcccacccgcgtggtcgctagcgagatggccgaagccctgaagggcatgcctattcggtaccagacgacagctgtgaagtccgagcataccggaagagagatcgttgatctcatgtgccacgccaccttcacaatgcggctgctgtctcccgtgcgcgtccctaactataatatgattatcatggacgaagctcattttaccgatcccgccagcatcgcggccagaggctacatttccacacgggtggggatgggagaggctgccgctatcttcatgaccgccacgcctccgggcagcgtggaagcctttccccagtctaacgctgtcattcaggacgaggaacgcgatatccctgagagatcctggaatagcgggtatgactggattacagatttccccggaaaaaccgtttggttcgtgccttctatcaagagcggcaacgacatcgcgaattgtctccggaaaaacgggaagagagtgattcaactttcccgcaaaacatttgataccgagtaccagaagacgaagaacaatgactgggactatgtcgtgaccacagatatctctgaaatgggcgccaacttccgggctgacagagttattgatccccgccggtgcctgaaaccggtgatcctgaaggacggacctgagagagtcattctcgccggccccatgcccgtgaccgttgccagcgctgcccagcgccgggggagaatcggacgcaatcagaacaaagaaggcgatcaatacgtgtacatggggcagcctctgaataacgacgaggatcacgcgcattggacagaggctaagatgcttctggacaatattaacacccccgaaggaatcatccctgccctctttgagccggaaagagagaaatccgccgctattgatggcgaatatcggctgcgcggggaggccagaaagacattcgtcgagctgatgcggcgcggcgacctccccgtgtggctttcttacaaggtcgcgagcgaaggatttcagtattccgatagacggtggtgcttcgacggcgagagaaataaccaggtgctggaagagaatatggatgttgaaatctggaccaaagagggggagcgcaagaaactgcggcctagatggctcgacgcccgcacgtacagcgaccccctggctcttcgggaatttaaggagttcgccgctggaagacggtctgtgtccggcgatctgattctcgaaatcgggaaactgcctcaacacctgacactccgcgcccagaacgctcttgacaatctggtgatgctgcacaacagcgagcagggaggcaaggcctatagacatgcgatggaagagctccccgataccattgagaccctgatgcttctggccctcatcgctgtcctgacaggcggggttaccctgtttttcctctccggaaaaggccttgggaagacatctatcggactgctgtgtgtgacggccagctccgctctcctgtggatggcctctgtggaaccgcactggattgccgctagcatcattcttgagtttttcctgatggtcctcctgatccctgaacccgaccggcagcgcacccctcaagataatcagctggcgtacgtggttattggcctcctttttatgatcctgacagtggccgctaacgagatggggctgctcgagaccacaaagaaagacctgggaatcggctatgtcgccgccgaaaaccatcagcacgctaccatgcttgatgtggacctgcaccccgcctccgcgtggacgctctacgccgtcgctaccacagtgattacccctatgatgagacatacaatcgagaataccacggccaacattagcctgacagctatcgccaatcaagcggccattctgatgggcctcgataaggggtggcccatctctaaaatggacattggagttccgcttctggctctgggctgctactcccaggtgaaccctctcaccctgacagccgctgtccttatgctggtggcccactatgctatcatcgggcccggactccaggccaaggcgacccgggaagcccagaaacgcaccgctgccggcattatgaagaatcccacagttgatgggatcgtggctattgacctggatcctgtcgtgtacgacgccaagttcgagaaacaactgggacagatcatgctccttattctgtgtacgagccagatcctgctcatgagaaccacatgggccctgtgcgaatctatcacccttgcgacaggcccgctgaccacgctctgggagggctcccccgggaagttctggaacacaaccattgctgtgagcatggccaatatctttcggggatcttatctggctggcgccgggctggccttcagcctcatgaaatcccttggaggcgggcgcagaggaaccggcgctcagggcgagacactgggggaaaagtggaaacggcaactgaaccagctctctaagagcgagtttaatacctacaagagatccggaattatggaagttgaccgcagcgaggccaaagaaggcctgaagcggggggagacaacgaaacatgcggtctccagaggaaccgccaagcttcgctggttcgtggagcggaacctggtgaaacctgaaggcaaggtcatcgatctcgggtgtggaagaggcggctggtcttattactgcgctgggctgaagaaagttacagaggtgaagggatataccaaaggcgggcccggacacgaagagcctattcccatggccacatacggctggaatctggtgaagctccatagcgggaaagacgtctttttcatgcctccggaaaagtgtgatacccttctgtgcgacatcggagagtcctctcccaaccctacgatcgaggaaggccgcaccctgcgggtgctcaaaatggttgagccctggctgagaggcaatcagttttgtattaagatccttaacccttacatgcccagcgtggtcgaaacactggagcagatgcaacgcaagcacgggggaatgctcgtgcggaatccgctgtccagaaactctacccacgagatgtattgggttagctgcggcacagggaatattgtgtccgctgtcaacatgaccagccgcatgctgctcaaccggttcacaatggcccatagaaaacctacctacgaacgcgatgtggacctgggagcgggcacgagacacgtggccgtcgagcccgaagttgctaatcttgatatcattgggcagcggatcgagaacattaagaatgaacataaatctacatggcactatgacgaggataacccctacaagacctgggcctatcacggatcctacgaggtgaaacctagcggctctgcttccagcatggtgaatggcgtcgtgcgcctgctcaccaagccctgggacgttatccctatggtgacacagatcgccatgacggataccacaccgtttgggcaacagagagtcttcaaggaaaaagtggacacccggacacccagagctaagcggggaaccacacagattatggaggttaccgccaaatggctgtggggctttctttctcgcaacaagaaacctagaatctgtacgcgggaagagttcacccgcaaggtgagatccaatgcggccattggggctgtctttgtggacgaaaaccagtggaatagcgccaaggaggctgttgaggatgaacggttctgggacctggtgcatcgcgagagagaactccacaaacaaggaaagtgcgccacatgcgtctataacatgatgggcaaacgggagaagaaactgggggaattcggcaaggccaagggatcccgcgcgatctggtacatgtggctgggcgctagatttctcgagttcgaggccctggggtttatgaatgaagatcattggttcagccgggagaactctcttagcggagtggaaggcgaggggctgcacaaactcggatacattctgcgcgacatctccaagatccccggcgggaatatgtatgccgatgacaccgctggctgggatacaagaattaccgaggacgatcttcagaacgaagccaaaatcacggacattatggagcctgaacatgctctgctcgccacatctatctttaagctgacctaccagaataaagtcgtgcgggttcagcgccccgcgaagaacggaacagtgatggatgtcattagcagacgggaccaaagaggctccgggcaggtgggaacctatggcctgaacacgttcaccaatatggaggtgcagctcatccgccagatggaatctgaggggatctttctgccgagcgagcttgaaacacctaacctggccgagcgggctctcgattggctggaaaaacacggagccgagagacttaagcgcatggctatttccggcgacgactgtgttgtgaagcccatcgatgaccggttcgccaccgcgctgacagccctcaatgatatggggaaagtcagaaaggacattcctcaatgggaaccctctaaaggctggaacgattggcagcaggtgcctttttgcagccaccatttccaccagctgatcatgaaggacggacgcgagattgttgtgccctgtcggaatcaagatgagctggtcggcagagctcgcgtgtcccagggggccggatggagcctccgggaaaccgcttgcctgggcaaatcttacgcccagatgtggcaacttatgtattttcatagacgcgacctgcggctcgctgccaacgcgatctgttccgccgtcccggtggattgggttcctgctagcagaacaacctggtctatccacgcccaccatcagtggatgacgacagaggacatgctgtccgtgtggaatcgggtctggattgaagagaacccctggatggaagataagacccacgtgagctcctgggaggaggttccctaccttgggaagagagaagaccagtggtgcggatctctgatcggcctcaccgcccgcgctacatgggccaccaatattcaggtggcgatcaaccaagtccggagactgattgggaatgagaactatctggactacatgacaagcatgaaacgcttcaagaatgaatccgatcctgagggcgctctctggtga

SEQ ID NO: 18463 - RNA, 9879 nt, synthetic construct
  misc_feature 1..9879: note = derived and/or modified CDS sequence (opt5) from DENV-1__JX669467__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccaacggcatcctggctcaggggaaaaagatgattcggccgcaacccatggagcacaaatactcctggaagtcttggggaaaggccaaaatcattggcgccgacatccagaataccacatttatcattgatgggcctgacacccccgaatgtcctgatgagcagagagcttggaacatctgggaggtcgaagactatggattcggcatttttacgacaaatatctggctgaagcttcgcgatagctacacccagatgtgcgaccaccggctcatgtccgcggccattaaagatagcaaggctgttcatgccgacatgggctattggatcgagtctgaaaaaaacgagacatggaagctggccagagcttccttcatcgaagtgaagacctgtatttggcccaaaagccacacactgtggtctaatggggtgctcgagtccgagatgatcattccgaagatgtacggaggccctatcagccaacataactatcgccccgggtacttcacccagacggccggaccttggcacctgggcaaacttgaactggattttgacctctgcgaggggaccacagtcgtggttgatgaacactgcggatctcggggccccagcctgagaaccacaaccgtgacgggcaagattatccatgagtggtgttgccggtcctgtacactgcctccccttcgcttcagaggggaggacggatgctggtacggcatggaaatccggccggtcaaagagaaggaagagaatctcgtgagaagcatggtttctgcggggtccggagaagtggatagcttttccctgggcattctgtgtgtctctatcatgattgaggaggtgatgcgcagccggtggtccagaaagatgctcatgaccgggacactggctgttttccttctgctcatcatgggacagctgacctggaacgacctgattcgcctttgcatcatggtgggcgccaatgcctctgacaaaatgggcatggggaccacatatctggctctcatggccacgtttaagatgagacctatgttcgcggtcggactgctctttcggcgcctgaccagcagagaagtgcttctgctcacaattggcctgtccctggtggcttctgtcgagcttcccaacagcctggaagagctcggggatggactggccatgggcatcatgatgctcaaactgcttaccgaattccaaccccaccagctgtggacaaccctcctgtccctgacgtttatcaagacaacccttagcctggactacgcctggaaaaccacagctaccgttctctctattgtgtccctgttccctctctgtctgagcacaacgtctcagaagaccacatggcttccggtgctgctggggtcctttggatgcaagcccctcaccatgttcctgatcacagagaacgagatttggggccggaaaagctggcctcttaatgaaggcatcatggccattgggatcgtctctatcctgctctccagcctgctcaagaacgatgtgcccctggctggacctcttattgccggcgggatgctgatcgcgtgttatgttatttccggaagctctgccgacctgagcctcgagaaagctgccgaagtgtcctgggaggaagaggctgagcattctggcaccagccacaatatcctggtcgaagtgcaggatgacgggacgatgaagattaaagatgaggaacgcgacgatacccttacaatcctgctcaaggccaccctgctcgccgtttccggagtgtaccccatgtctatccctgctacactgtttgtctggtatttctggcaaaaaaagaagcagagaagcggcgtgctttgggacaccccctccccgcctgaggtcgagcgggcggtgctggatgacggcatttaccgcatcctgcagagagggctcctgggacggtctcaggttggcgtgggggtcttccaagatggagtgtttcatacaatgtggcacgttacgcgcggcgccgtgcttatgtatcaggggaaaagactggaacccagctgggcttccgtcaagaaagacctcattagctacggaggcggctggcggttccaggggtcttggaacaccggagaggaagtgcaggtgatcgccgttgagcctggcaagaatcccaaaaacgtccaaacaaccccggggacctttaagacacctgaaggagaggtgggcgccattgctctggacttcaagcccgggacgtccggaagccctatcgtgaatagagagggcaaaattgtcggcctctacgggaacggagtggttaccacatctggcacctatgtgtccgccatcgcgcaggctaaggccagccaggaagggcccctgcccgagatcgaagatgaggtctttaaaaagcgcaatcttacaattatggacctgcaccctggatccggcaaaacccggagatacctgccggccatcgtgcgcgaagctattaagcggaagctcagaacgctgatccttgcccccacacgcgttgtggcgtctgagatggctgaggccctgaaagggatgcctattcggtatcaaaccaccgccgtcaagagcgaacatacaggcagagagatcgtggatctcatgtgccacgctaccttcacaatgcgcctgctgtcccccgttcgggtgcctaactacaatatgatcattatggacgaagcccattttaccgatcccgctagcatcgccgcgagaggatatatttctacgcgggtcggcatgggggaggccgctgccatcttcatgacagctacccctccgggatccgtggaagcctttccccagagcaacgccgtgattcaggacgaggagcgcgatatccctgaaagatcttggaatagcggctacgactggatcacagatttccccgggaaaaccgtctggtttgttccttccattaagtctggaaacgacatcgctaattgtctccggaaaaacggcaagcgcgtgattcagcttagcagaaagacgttcgataccgagtatcaaaaaacaaagaacaatgactgggactacgtggtcaccacagatatctccgaaatgggggcgaacttccgggccgacagagtgattgatccccgccggtgcctgaaaccggttatcctgaaggacggccctgagagagtgattctcgctggacccatgcccgtcaccgtggcctctgccgctcagcgccggggcagaatcgggcgcaatcagaacaaagagggagatcagtacgtttatatgggccaacctctgaataacgacgaagatcacgcccattggacagaggcgaagatgcttctggacaatatcaacacccccgaagggattatccctgctctctttgagccggaacgggagaagagcgccgccattgatggagagtacagactgcgcggcgaagctagaaaaacgttcgtggagctgatgcggcgcggggacctccccgtctggctttcctataaggtggccagcgaaggctttcagtactctgatagacggtggtgcttcgacggagagcgcaataaccaggtcctggaagagaatatggatgtggagatctggacaaaagaaggcgagagaaagaaactgcggcctagatggctcgacgcgcgcacctattccgaccccctggcccttcgggaatttaaggagttcgctgccgggagacgcagcgtttccggagatctgattctcgaaatcggcaaactgcctcagcacctgaccctccgggctcaaaacgcccttgacaatctggtgatgctgcacaactctgagcaggggggaaaggcttacagacatgccatggaggaactccccgatacaatcgagaccctgatgcttctggcgctcattgccgtgctgacaggcggcgtcacgctgtttttcctcagcgggaagggacttggcaaaacctccatcgggctgctgtgtgttacagcttctagcgccctcctgtggatggcttccgtggaaccgcactggattgccgccagcatcattcttgagtttttcctgatggtgctcctgatccctgagcccgaccggcagcgcacccctcaggataatcaactggcttatgtcgtgatcggactcctttttatgattctgacagttgcggccaacgaaatgggcctgctcgagaccacgaagaaagacctggggatcggacatgtggctgccgaaaaccaccagcacgccaccatgcttgatgtcgacctgcatcccgcttctgcctggacactctacgcggtggccaccacagtcattacccctatgatgagacacacgatcgagaatacaaccgctaacatttccctgacagccatcgctaatcaggccgcgattctgatgggcctcgataagggctggcccatcagcaaaatggaccttggggtgccgctgctggccctcggatgctactctcaagttaaccctctgacccttaccgctgccgtgctgatgctcgtcgctcattatgccatcattggccccgggctgcaggctaaggccacacgggaagcgcagaagcgcacggccgctggaatcatgaaaaatcccaccgtggatggcattgttgccatcgacctggatcctgtggtctacgacgctaagttcgagaaacagctcgggcaaattatgcttctgatcctgtgtacatcccagatcctcctgatgagaaccacatgggccctttgcgagagcattaccctggccacgggaccgctcacaaccctgtgggaaggctctcccggcaagttttggaacaccacaatcgcggtgagcatggctaatattttccgggggtcctatctggccggagctggcctcgccttctctcttatgaaaagcctggggggaggccgcagagggaccggagcccagggcgagacactgggcgaaaagtggaagcggcagctcaaccaactgtccaaaagcgagtttaatacgtacaagcgctccgggatcatggaagtggacagatctgaggctaaagagggacttaagcggggcgaaaccacaaaacacgccgttagcagagggaccgcgaagctgcgctggttcgtcgagcggaacctcgtgaagcctgaaggaaaagtgattgatctgggctgtgggagaggaggctggtcctattactgcgccggcctgaagaaagtcacagaggttaaggggtataccaaaggaggccccgggcatgaagagcctatccccatggctacgtacggatggaatctcgtgaagcttcactctggcaaagacgtgtttttcatgcctccggagaagtgtgataccctgctgtgcgacatcggggaaagctcccccaaccctacaattgaggaaggacgcaccctccgggtcctgaagatggtggagccctggcttagaggcaatcagttttgtatcaaaattctgaacccttacatgccctctgttgtggagacactcgaacagatgcagcgcaagcacggcgggatgctggtccggaatccgctgagcagaaactccacccatgagatgtattgggtgagctgcggaacaggcaatatcgtttctgccgtgaacatgacctcccgcatgctcctgaaccggttcacgatggctcacagaaaacctacatacgaacgcgatgtcgaccttggggccggaacccggcatgtggcggtggagcccgaagtcgccaatctggatattatcggccaaagaattgagaacatcaagaatgagcacaaaagcacctggcactatgacgaagataacccctacaagacatgggcttatcatgggtcttacgaggttaagccttccggaagcgcctcttccatggtgaatggcgtggtccgcctcctgacgaaaccctgggacgtgatccctatggttacccagattgctatgacagataccacaccgtttggccagcaaagagtgttcaaggaaaaagtcgacacccggacaccccgcgccaagagagggaccgctcagatcatggaggtgacggccaaatggctttggggatttctgagccggaacaagaagcctagaatttgtacccgggaagagttcacacgcaaagttagatccaatgcggccatcggcgctgtgtttgtcgacgagaaccagtggaatagcgccaaggaagctgtggaggatgaacggttctgggacctcgttcaccgcgagagagaactgcataaacaggggaagtgcgccacctgcgtgtataacatgatgggaaaacgggagaagaagctgggcgagtttgggaaagccaagggctctcgcgcgatttggtacatgtggctcggagctagattcctggaattcgaggcccttggctttatgaatgaagatcactggttcagccgggagaactccctgtctggggtcgagggagaaggcctccataaactggggtacatccttcgcgacatcagcaagattcccggaggcaatatgtatgccgatgacacagctgggtgggataccagaatcacggaggacgatctgcaaaacgaagccaaaattacagacatcatggagcctgaacacgctctcctggccacctccatttttaagctgacataccagaataaagtggtccgggtgcagcgccccgcgaagaacggcaccgttatggatgtgatctctagacgggaccagcgcggaagcggccaagtcgggacgtatggactcaacaccttcacaaatatggaggtgcagctgatcagacagatggagtccgaaggcatttttttcccgtctgagcttgaaagccctaacctggccgagcgggtgctcgattggctggaaaagcacggggctgagagacttaaacgcatggccatctccggagacgactgtgttgtgaagcccattgatgaccggtttgctaccgccctgatcgcgctcaatgatatgggcaaagtcagaaaggacattcctcagtgggagcccagcaaagggtggaacgattggcaacaggtgcctttctgctctcatcactttcatcagctgatcatgaaggacggccgcgaaatcgttgtgccctgtcggaatcaggatgagctggtcggaagagcccgcgtgtcccaaggcgctgggtggagcctccgggaaacagcctgcctgggaaagtcttacgctcagatgtggcagcttatgtatttccacagacgcgacctgcggctcgccgctaacgccatttgttccgcggtcccggtggattgggttcctaccagcagaacaacctggtccatccacgcccatcaccaatggatgacgacagaggacatgctgtctgtgtggaatcgcgtctggattgaagagaacccctggatggaggataaaacccatgtgagctcctgggaagaggttccctaccttggcaagcgggaagaccagtggtgcgggagcctgatcggactcaccgctagagccacatgggccaccaatattcaggtggctatcaaccaggtccggagactgattggcaatgagaactatctggactacatgacatctatgaaacgctttaagaatgagtccgatcctgaaggggccctctggtga

SEQ ID NO: 18464 - RNA, 9879 nt, synthetic construct
  misc_feature 1..9879: note = derived and/or modified CDS sequence (opt5) from DENV-1__HM469967__SS-prME
  source 1..9879: mol_type = other RNA
agcgtgaccatgctgctcatgctgatgcccaccgctcttgctttccacctgacgaccagaggcggggagcctcatatgatcgtctccaagcaggaacggggaaaatctctcctgtttaagaccagcgctggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtcgaggactacggattcggcatttttaccacgaacatctggctgaagctgcgcgattcctatacacaggtttgcgaccaccggcttatgagcgccgctattaaagattctaaggccgtgcacgccgacatgggctactggatcgaatccgagaaaaatgaaacctggaagctcgctagagccagcttcatcgaggtgaagacatgtatttggcccaaatctcataccctgtggtccaacggggtcctggaaagcgagatgatcattccgaagatctatggaggccctatttctcaacacaattaccgccccgggtacttcacacagaccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggaaaatgctcatgacagggaccctggccgttttctttcttctgattatgggacagctcacatggaacgatctgatcagactgtgcattatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcatcatgattctgaaactcctgacagactttcaatcccatcagctttgggctaccctgctcagcctgacattcatcaagaccacgttttctctgcactatgcctggaaaacaatggctatggttctttccattgtgagcctgttccccctctgtctgtctaccacctcccagaagacaacctggctccctgtgctgcttgggagcctgggatgcaagccgctgacaatgtttctcatcgccgagaataaaatttggggccggaagtcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgcgacgataccctgacaatccttctgaaagccaccctcctggctgtgtctggagtctatcctctcagcattcccgccacactgttcgtgtggtacttctggcaaaagaagaaacagagatccggcgtcctttgggacaccccttctcccccgaaggtggaacgggccgttctggatgacggcatctatcgcattatgcagagagggctgctcggacggagccaggtgggcgtcggggtgtttcaagagaacgttttccatacgatgtggcacgtgacccgcggagctgtcctgatgtaccagggcaaaagacttgaaccttcctgggccagcgtgaagaaagacctgatctcttacgggggaggctggcggctccagggctcctggaatacaggggaggaggtgcaggttattgcggtcgaacccggaaagaaccctaagaatgtgcaaaccgctcccggcacatttaaaaccccggagggggaaatcggagccattgccctggatttcaagcctggcacaagcgggtctcccatcgtgaacagagagggaaaaatcgtcggcctctatggcaatggggtggttacgacctccggaacatacgtgagcgctattgcccaggcgaaggcttcccaggaaggccctctgcccgagatcgaggacgaagtctttcgcaaacggaaccttaccattatggatctgcaccccgggtctggaaagaccagacgctatctgcctgccatcgtgcgggaggccattaagagaaaactccgcacactgatccttgctccgacgcgggttgtggccagcgaaatggctgaggccctgaagggcatgcccatcagataccaaaccacagcggtcaaatccgaacataccgggaaggagattgtggacctcatgtgccacgccacattcaccatgcgcctgctgagccctgttcgggtgcccaattataacatgatcattatggatgaggctcattttacggacccttcttccatcgccgctagaggctacattagcacacgggtcggaatgggcgaagccgccgctatcttcatgaccgcgacaccccctgggtctgtggaggcctttccgcagagcaatgctgtgatccaggatgaagaacgcgacattcccgaaagatcctggaactctggatatgagtggatcacagatttccctggcaaaaccgtctggtttgttcccagcattaaggccgggaatgacatcgccaactgtctccggaagaatggaaaacgcgtgattcagctttccagaaagacattcgataccgagtaccagaagacgaagaactctgactgggactacgtggtcacaaccgatatcagcgaaatgggcgctaacttccgggccgacagagtgattgatcctcgccggtgcctgaaacccgttatcctgaaggacgggccggagagagtgatcctcgcgggccctatgcccgtcacagtggcttccgccgcccagcgccggggaagagttggccgcaatcacaacaaggaaggggatcagtatatttacatgggacagcccctgaataacgacgaggatcatgctcactggaccgaggccaaaatgcttctggacaatatcaacacgcctgaaggcattatccccgcgctctttgagcctgaacgggaaaagagcgccgctattgatggggaatatagactgcgcggagaggccagaaaaaccttcgtggagctgatgcggcgcggcgacctcccggtctggctttcttacaaggtggcttccgaagggtttcaatatagcgatagacggtggtgcttcgacggcgagcgcaataaccaggtcctggaagagaatatggatgtggaaatctggacaaaagagggagagagaaagaaactgcggcccagatggctcgacgcccgcacctactccgaccctctggcccttcgggaatttaaggagttcgccgcgggcagacgctctgttagcggggatctgatcctcgaaattggaaagctgccccagcacctgacacagcgggcccaaaacgctctcgacaatcttgtgatgctgcataactccgagcagggcgggagagcctatcggcacgctatggaggaactgcctgataccatcgagacactcatgctgcttgccctgattgccgtgctcaccggaggcgtcacgctgtttttcctgtctggccgcgggctcggaaaaacaagcatcggccttctgtgtgttatggcttccagcgtgctgctctggatggcgtctgtggaaccccattggattgccgcttccatcatcctggagtttttccttatggtcctgctcattccggaacctgacagacagcggacaccccaggataatcaactggcctacgtggttatcgggctgctctttatgattcttaccgtggccgctaacgagatgggactgctggagacaaccaagaaagacctcggcatcgggcacgtcgccgtggaaaatcaccatcacgcggccatgctggatgtcgaccttcatcctgctagcgcctggacactgtacgctgtggccacgaccattatcacacccatgatgcgccacaccattgagaacacaaccgcgaacatctctctcacggccatcgctaatcaggccgctattctgatgggactggataagggctggcctatctccaaaatggacattggcgttcccctccttgccctggggtgctatagccaggtgaacccgctgaccctcacagctgccgtcctgatgcttgtggcgcattacgccatcattggacctggcctgcaagctaaggccaccagagaagctcagaagcggacagccgccgggatcatgaaaaatcccaccgttgatggaatcgtggcgattgacctcgatcccgtcgtgtatgacgctaagttcgagaaacagctgggccagatcatgctgctcattctttgtacgtctcaaatcctgctgatgcgcacaacctgggccctctgcgaaagcattacactggctaccgggcctcttaccacactgtggaagggatccccgggcaaattttggaacacgaccatcgccgtgtctatggccaatatcttcagaggcagctacctcgctggggccggactggcgttctccctgatgaaaagcctcggcgggggacggcgcggcacaggggcccagggagagacccttggcgagaagtggaaaagacagctgaaccagctgtccaagtctgaatttaatacatataaacggagcggcattatggaggttgacagatccgaagctaaggaggggctcaaacgcggagaaaccacgaagcacgccgtctctcggggcacagctaagctgaaatggttcgtggagagaaaccttgtgaagcccgaggggaaagtcatcgatctgggatgtggccgcgggggatggagctactattgcgccggcctcaagaaagttaccgaagtgaagggctacaccaaagggggacctggccacgaggaacccattcctatggcgacatacgggtggaatctggtgaagctgcattccggaaaggacgtctttttcattccccctgagaaatgtgataccctcctttgcgacattggcgaatctagcccgaaccccacaatcgaggaggggcggacgctgagagtgctgaagatggttgaaccttggctccgcaaaaatcaattttgtattaagatcctgaacccctatatgccttccgtggtcgagacccttgaacagatgcagcggaaacacggaggcatgctggtgagaaatcccctcagccgcaactctacacatgagatgtactgggtttcctgcggcaccgggaatatcgtgagcgccgtcaacatgacatctcggatgctgctgaatagattcaccatggctcaccgcaagccgacgtatgagcgggatgtggacctcggagccggcaccagacacgtggctgtcgaacctgaggttgccaacctggatattatcgggcagcgcattgaaaacatcaagcatgagcacaaatccacatggcattacgacgaagataatccctataagacctgggcttaccacggaagctatgaggtgaaaccctctggctccgccagctccatggtgaacggggtcgtgaaacttctgacaaaaccttgggacgttattcccatggtgacccaaatcgcgatgacagataccacgccttttggacagcagagagtcttcaaggagaaggtggacacacggaccccgaaagccaagcgcggcaccgctcaaatcatggaagttacagccagatggctctggggctttctgagccggaataaaaagcccagaatttgtacgcgggaggagttcacccgcaaagtgagatctaacgctgccatcggggccgtctttgtggacgagaatcagtggaacagcgcgaaggaagctgttgaggatgagcggttctgggaccttgtgcatcgcgaaagagagctgcacaagcagggaaaatgcgccacatgcgtctacaatatgatgggcaagcgggagaagaagctcggggagtttggaaaagccaagggctcccgcgctatttggtacatgtggctgggggccagattcctggagttcgaggctctcggctttatgaacgaggatcactggttctctcgggaaaatagcctgtccggagtggagggcgaagggcttcataaactgggatatatcctccgcgacatttctaagatccctggcgggaacatgtacgccgatgacaccgcgggatgggatacaagaatcaccgaggacgatctgcagaatgaggccaagattacagacatcatggaacccgagcacgcccttctggccaaaagcatttttaagctcacctatcaaaacaaagtcgtgcgggttcagcgccctgctaagaatggcacggtgatggatgtcatctccagacgggaccagcgcgggtctggccaggtgggaacctacggcctgaacacattcaccaatatggaagcccaactgattagacagatggagagcgaagggatcttttcccccagcgagctcgagacaccgaacctggcggaacgggtgcttgattggctggagaaatatggagttgaaagactcaagcgcatggccatctctggcgacgactgtgtggtcaagcctattgatgaccggttcgctaccgccctgacggctcttaacgatatggggaaagtgagaaaggacatcccccagtgggagccttccaaaggatggaatgattggcagaaggttcccttttgcagccatcacttccaccaactgattatgaaagacggccgcgaaatcgtggtcccttgtcggaaccaggatgagctcgtggggagagcccgcgtctctcagggcgctggatggtccctgcgggagacagcctgcctgggcaagagctacgcgcagatgtggcaactcatgtattttcatagacgcgacctgcggcttgccgctaatgccatttgttccgccgtgcccgttgattgggtgccgacctctagaacaacctggagcatccacgctcatcaccagtggatgacgaccgaagacatgctgtccgtctggaaccgcgtgtggattgaggaaaatccttggatggaggataagacacatatcagctcttgggaagacgttccctacctcgggaaacgggaggaccagtggtgcggatccctgatcggccttaccgccagagcgacatgggctaccaacattcaagtggccatcaatcaggtccggagactgattgggaacgagaattacctcgattatatgacaagcatgaagcgcttcaaaaacgaatctgaccccgagggagccctgtggtga

SEQ ID NO: 18465 - RNA, 9879 nt, synthetic construct
  misc_feature 1..9879: note = derived and/or modified CDS sequence (opt5) from DENV-1__JX669468__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggaacggaatcttcgtgacaaatgaggttcacacctggacggaacaatataaatttcaggctgattcccctaagcgcctcagcgccgcgattggccgggcctgggaggagggggtgtgcggcatcagatccgctacacgcctggaaaacattatgtggaaacagatctctaatgagcttaaccatatcctgctcgaaaatgacattaagttcaccgtcgtggtgggaaacgccaatggcatcctggctcaggggaaaaagatgattcggccgcaacccatggagcacaaatacagctggaagtcctggggaaaggccaaaatcattggcgccgacatccagaacaccacatttatcattgatgggcctgacacccccgaatgtcctgatgagcagagagcttggaatatctgggaggtcgaagactatggattcggcatttttacgacaaacatctggctgaagcttcgcgattcttacacccagatgtgcgaccaccggctcatgagcgcggccattaaagattccaaggctgttcatgccgacatgggctattggatcgagagcgaaaaaaatgagacatggaagctggccagagcttctttcatcgaagtgaagacctgtatttggcccaaatcccacacactgtggagcaacggggtgctcgagtctgagatgatcattccgaagatgtacggaggccctatctcccaacataattatcgccccgggtacttcacccagacggccggaccttggcacctgggcaaacttgaactggattttgacctctgcgaggggaccacagtcgtggttgatgaacactgcggaagccggggcccctctctgagaaccacaaccgtgacgggcaagattatccatgagtggtgttgccggagctgtacactgcctccccttcgcttcagaggggaggacggatgctggtacggcatggaaatccggccggtcaaagagaaggaagagaacctcgtgagatccatggttagcgcggggtctggagaagtggattcctttagcctgggcattctgtgtgtctccatcatgattgaggaggtgatgcgctctcggtggagcagaaagatgctcatgaccgggacactggctgttttccttctgctcatcatgggacagctgacctggaatgacctgattcgcctttgcatcatggtgggcgccaacgcctccgacaaaatgggcatggggaccacatatctggctctcatggccacgtttaagatgagacctatgttcgcggtcggactgctctttcggcgcctgacctctagagaagtgcttctgctcacaattggcctgagcctggtggcttccgtcgagcttcccaactctctggaagagctcggggatggactggccatgggcatcatgatgctcaaactgcttaccgaattccaaccccaccagctgtggacaaccctcctgagcctgacgtttatcaagacaaccctttccctggactacgcctggaaaaccacagctaccgttctcagcattgtgtctctgttccctctctgtctgtccacaacgagccagaagaccacatggcttccggtgctgctggggtcttttggatgcaagcccctcaccatgttcctgatcacagagaatgagatttggggccggaaatcctggcctcttaacgaaggcatcatggccattgggatcgtcagcatcctgctctcttccctgctcaagaatgatgtgcccctggctggacctcttattgccggcgggatgctgatcgcgtgttatgttattagcggatccagcgccgacctgtctctcgagaaagctgccgaagtgagctgggaggaagaggctgagcattccggcacctctcacaacatcctggtcgaagtgcaggatgacgggacgatgaagattaaagatgaggaacgcgacgatacccttacaatcctgctcaaggccaccctgctcgccgttagcggagtgtaccccatgtccatccctgctacactgtttgtctggtatttctggcaaaaaaagaagcagagatctggcgtgctttgggacacccccagcccgcctgaggtcgagcgggcggtgctggatgacggcatttaccgcatcctgcagagagggctcctgggacggtcccaggttggcgtgggggtcttccaagatggagtgtttcatacaatgtggcacgttacgcgcggcgccgtgcttatgtatcaggggaaaagactggaaccctcttgggctagcgtcaagaaagacctcatttcctacggaggcggctggcggttccaggggagctggaataccggagaggaagtgcaggtgatcgccgttgagcctggcaagaaccccaaaaatgtccaaacaaccccggggacctttaagacacctgaaggagaggtgggcgccattgctctggacttcaagcccgggacgtctggatcccctatcgtgaacagagagggcaaaattgtcggcctctacgggaatggagtggttaccacaagcggcacctatgtgtctgccatcgcgcaggctaaggcctcccaggaagggcccctgcccgagatcgaagatgaggtctttaaaaagcgcaaccttacaattatggacctgcaccctggaagcggcaaaacccggagatacctgccggccatcgtgcgcgaagctattaagcggaagctcagaacgctgatccttgcccccacacgcgttgtggcgtccgagatggctgaggccctgaaagggatgcctattcggtatcaaaccaccgccgtcaagtctgaacatacaggcagagagatcgtggatctcatgtgccacgctaccttcacaatgcgcctgctgagccccgttcgggtgcctaattacaacatgatcattatggacgaagcccattttaccgatcccgcttccatcgccgcgagaggatatattagcacgcgggtcggcatgggggaggccgctgccatcttcatgacagctacccctccgggatctgtggaagcctttccccagtccaatgccgtgattcaggacgaggagcgcgatatccctgaaagaagctggaactctggctacgactggatcacagatttccccgggaaaaccgtctggtttgttcctagcattaagtccggaaatgacatcgctaactgtctccggaaaaacggcaagcgcgtgattcagctttctagaaagacgttcgataccgagtatcaaaaaacaaagaataacgactgggactacgtggtcaccacagatatcagcgaaatgggggcgaatttccgggccgacagagtgattgatccccgccggtgcctgaaaccggttatcctgaaggacggccctgagagagtgattctcgctggacccatgcccgtcaccgtggcctccgccgctcagcgccggggcagaatcgggcgcaaccagaataaagagggagatcagtacgtttatatgggccaacctctgaacaatgacgaagatcacgcccattggacagaggcgaagatgcttctggacaacatcaatacccccgaagggattatccctgctctctttgagccggaacgggagaagtctgccgccattgatggagagtacagactgcgcggcgaagctagaaaaacgttcgtggagctgatgcggcgcggggacctccccgtctggcttagctataaggtggcctccgaaggctttcagtacagcgatagacggtggtgcttcgacggagagcgcaacaatcaggtcctggaagagaacatggatgtggagatctggacaaaagaaggcgagagaaagaaactgcggcctagatggctcgacgcgcgcacctattctgaccccctggcccttcgggaatttaaggagttcgctgccgggagacgctccgttagcggagatctgattctcgaaatcggcaaactgcctcagcacctgaccctccgggctcaaaatgcccttgacaacctggtgatgctgcacaattccgagcaggggggaaaggcttacagacatgccatggaggaactccccgatacaatcgagaccctgatgcttctggcgctcattgccgtgctgacaggcggcgtcacgctgtttttcctctctgggaagggacttggcaaaaccagcatcgggctgctgtgtgttacagcttcctctgccctcctgtggatggctagcgtggaaccgcactggattgccgcctccatcattcttgagtttttcctgatggtgctcctgatccctgagcccgaccggcagcgcacccctcaggataaccaactggcttatgtcgtgatcggactcctttttatgattctgacagttgcggccaacgaaatgggcctgctcgagaccacgaagaaagacctggggatcggacatgtggctgccgaaaatcaccagcacgccaccatgcttgatgtcgacctgcatcccgctagcgcctggacactctacgcggtggccaccacagtcattacccctatgatgagacacacgatcgagaacacaaccgctaatatttctctgacagccatcgctaaccaggccgcgattctgatgggcctcgataagggctggcccatctccaaaatggaccttggggtgccgctgctggccctcggatgctacagccaagttaatcctctgacccttaccgctgccgtgctgatgctcgtcgctcattatgccatcattggccccgggctgcaggctaaggccacacgggaagcgcagaagcgcacggccgctggaatcatgaaaaaccccaccgtggatggcattgttgccatcgacctggatcctgtggtctacgacgctaagttcgagaaacagctcgggcaaattatgcttctgatcctgtgtacatctcagatcctcctgatgagaaccacatgggccctttgcgagtccattaccctggccacgggaccgctcacaaccctgtgggaaggcagccccggcaagttttggaataccacaatcgcggtgtctatggctaacattttccgggggagctatctggccggagctggcctcgccttctcccttatgaaatctctggggggaggccgcagagggaccggagcccagggcgagacactgggcgaaaagtggaagcggcagctcaatcaactgagcaaatccgagtttaacacgtacaagcgcagcgggatcatggaagtggacagatccgaggctaaagagggacttaagcggggcgaaaccacaaaacacgccgtttctagagggaccgcgaagctgcgctggttcgtcgagcggaatctcgtgaagcctgaaggaaaagtgattgatctgggctgtgggagaggaggctggagctattactgcgccggcctgaagaaagtcacagaggttaaggggtataccaaaggaggccccgggcatgaagagcctatccccatggctacgtacggatggaacctcgtgaagcttcactccggcaaagacgtgtttttcatgcctccggagaagtgtgataccctgctgtgcgacatcggggaatctagccccaatcctacaattgaggaaggacgcaccctccgggtcctgaagatggtggagccctggcttagaggcaaccagttttgtatcaaaattctgaatccttacatgccctccgttgtggagacactcgaacagatgcagcgcaagcacggcgggatgctggtccggaacccgctgtctagaaatagcacccatgagatgtattgggtgtcctgcggaacaggcaacatcgttagcgccgtgaacatgacctctcgcatgctcctgaatcggttcacgatggctcacagaaaacctacatacgaacgcgatgtcgaccttggggccggaacccggcatgtggcggtggagcccgaagtcgccaacctggatattatcggccaaagaattgagaatatcaagaacgagcacaaatccacctggcactatgacgaagataatccctacaagacatgggcttatcatgggagctacgaggttaagccttctggatccgccagctctatggtgaacggcgtggtccgcctcctgacgaaaccctgggacgtgatccctatggttacccagattgctatgacagataccacaccgtttggccagcaaagagtgttcaaggaaaaagtcgacacccggacaccccgcgccaagagagggaccgctcagatcatggaggtgacggccaaatggctttggggatttctgtcccggaataagaagcctagaatttgtacccgggaagagttcacacgcaaagttagaagcaacgcggccatcggcgctgtgtttgtcgacgagaatcagtggaactccgccaaggaagctgtggaggatgaacggttctgggacctcgttcaccgcgagagagaactgcataaacaggggaagtgcgccacctgcgtgtataatatgatgggaaaacgggagaagaagctgggcgagtttgggaaagccaagggcagccgcgcgatttggtacatgtggctcggagctagattcctggaattcgaggcccttggctttatgaacgaagatcactggttctctcgggagaatagcctgtccggggtcgagggagaaggcctccataaactggggtacatccttcgcgacatctctaagattcccggaggcaacatgtatgccgatgacacagctgggtgggataccagaatcacggaggacgatctgcaaaatgaagccaaaattacagacatcatggagcctgaacacgctctcctggccaccagcatttttaagctgacataccagaacaaagtggtccgggtgcagcgccccgcgaagaacggcaccgttatggatgtgatctccagacgggaccagcgcggatctggccaagtcgggacgtatggactcaataccttcacaaacatggaggtgcagctgatcagacagatggagagcgaaggcatttttttcccgtccgagcttgaatctcctaatctggccgagcgggtgctcgattggctggaaaagcacggggctgagagacttaaacgcatggccatcagcggagacgactgtgttgtgaagcccattgatgaccggtttgctaccgccctgatcgcgctcaacgatatgggcaaagtcagaaaggacattcctcagtgggagccctccaaagggtggaatgattggcaacaggtgcctttctgcagccatcactttcatcagctgatcatgaaggacggccgcgaaatcgttgtgccctgtcggaaccaggatgagctggtcggaagagcccgcgtgtctcaaggcgctgggtggtccctccgggaaacagcctgcctgggaaagagctacgctcagatgtggcagcttatgtatttccacagacgcgacctgcggctcgccgctaatgccatttgttctgcggtcccggtggattgggttcctacctccagaacaacctggagcatccacgcccatcaccaatggatgacgacagaggacatgctgtccgtgtggaaccgcgtctggattgaagagaatccctggatggaggataaaacccatgtgtctagctgggaagaggttccctaccttggcaagcgggaagaccagtggtgcgggtccctgatcggactcaccgctagagccacatgggccaccaacattcaggtggctatcaatcaggtccggagactgattggcaacgagaattatctggactacatgacaagcatgaaacgctttaagaacgagtctgatcctgaaggggccctctggtga

SEQ ID NO: 18466 - RNA, 9879 nt, synthetic construct
  misc_feature 1..9879: note = derived and/or modified CDS sequence (opt5) from DENV-1__JX669469__SS-prME
  source 1..9879: mol_type = other RNA
agcgtgaccatgctgctcatgctgcttcccaccgctctggctttccacctcacgacccggggaggggaacctcatatgatcgtgtccaagcaggaacggggaaaatctctgctttttaagacaagcgctggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattaaagcgaagatctctaataccacgacagactcccgctgtccgacccaaggagaagccaccctcgtggaggaacaggatgctaacttcgtgtgcagacggacatttgtcgaccgcggctggggcaatgggtgtggactgttcggcaaggggagccttctgacctgcgccaaatttaagtgcgtgacaaaactcgagggaaagattgttcagtacgagaacctgaaatattctgtgatcgtcacggtgcacaccggcgatcagcatcaagttgggaatgaaacaaccgagcacggaacaatcgctaccattacgccccaggcccctacctccgaaatccagctgacagactacggcgccctcaccctggactgtagccccagaacaggccttgatttcaacgagatggtgctgctcaccatgaaggaaaaatcttggctggtccataagcagtggtttcttgacctgcctctcccctggacgtccggggctagcacatcccaagagacctggaatcggcaggatctgctggtgacattcaagaccgcgcacgccaaaaagcaggaggtcgtggttctcggatctcaagaaggcgctatgcacaccgccctgacaggggccacggagattcagaccagcggaacaaccacaatctttgctggccatcttaaatgccgcctgaagatggacaaactcaccctgaaggggacgtcctatgtgatgtgtacaggcagcttcaagctggaaaaagaggtcgccgaaacccagcacggaaccgtgcttgttcaggtgaagtacgagggcacagatgcgccgtgcaaaattcctttctctacccaagacgagaagggggtcacacagaacggaagactcatcacggctaatcccatcgtgaccgataaagaaaagcctgtgaacattgagacagaaccgccctttggcgagtcctatatcgttgtcggggccggagagaaggccctgaaactgagctggttcaagaaaggctctagcattgggaagatgtttgaagctaccgcccggggcgctagacgcatggccatcctcggagacacagcgtgggatttcggctccattgggggagtgtttacctctgtgggcaaactggtccatcaggtgttcgggacggcctacggagttctttttagcggcgtgtcctggaccatgaagatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagagctgaaatgtgggtccggaatcttcgtgacaaacgaagttcacacctggacggagcaatataagtttcaggctgatagccctaaacgcctctccgccgcgattggccgggcctgggaagagggggtgtgcggcatcagatctgctacacgcctggagaatattatgtggaagcagatcagcaacgaacttaatcatatcctgctcgagaacgacattaaattcaccgtcgtggtgggaaatgccaacggcatcctggctcaggggaagaaaatgattcggccgcaacccatggaacacaagtactcctggaagtcttggggaaaagccaagatcattggcgccgacatccagaataccacatttatcattgatgggcctgacacccccgagtgtcctgatgaacagagagcttggaacatctgggaggtcgaggactatggattcggcatttttacgacaaatatctggctgaaacttcgcgatagctacacccagatgtgcgaccaccggctcatgtccgcggccattaaggatagcaaagctgttcatgccgacatgggctattggatcgaatctgagaagaacgaaacatggaagctggccagagcttccttcatcgaggtgaaaacctgtatttggcccaagagccacacactgtggtctaatggggtgctcgaatccgagatgatcattccgaaaatgtacggaggccctatcagccaacataactatcgccccgggtacttcacccagacggccggaccttggcacctgggcaaacttgagctggattttgacctctgcgaagggaccacagtcgtggttgatgagcactgcggatctcggggccccagcctgagaaccacaaccgtgacgggcaaaattatccatgaatggtgttgccggtcctgtacactgcctccccttcgcttcagaggggaggacggatgctggtacggcatggagatccggccggtcaaggaaaaggaggaaaatctcgtgagaagcatggtttctgcggggtccggagaggtggatagcttttccctgggcattctgtgtgtctctatcatgattgaagaggtgatgcgcagccggtggtccagaaaaatgctcatgaccgggacactggctgttttccttctgctcatcatggcccagctgacctggaacgacctgattcgcctttgcatcatggtgggagccaatgcttctgacaagatgggcatgggcaccacatatctggccctcatggcgacgtttaaaatgagacctatgttcgctgtcgggctgctctttcggcgcctgaccagcagagaggtgcttctgctcacaattggactgtccctggtggcctctgtcgaacttcccaacagcctggaggaactcggcgatgggctggccatgggaatcatgatgctcaagctgcttaccgagttccaaccccaccagctgtggacaaccctcctgtccctgacgtttatcaaaacaacccttagcctggactacgcttggaagaccacagccatggttctctctattgtgtccctgttccctctctgtctgagcaccacatctcagaagacgacctggcttccggtgctgctgggctcctttgggtgcaaacccctcacaatgttcctgatcaccgaaaacgagatttggggaagaaagagctggcctcttaatgagggcatcatggctattggcatcgtctctatcctgctctccagcctgctcaaaaacgatgtgcccctggccgggcctcttattgcgggaggcatgctgatcgcctgttatgttatttccgggagctctgctgacctgagcctcgaaaaggccgctgaggtgtcctgggaagaggaagccgagcattctggaacaagccacaatatcctggtcgaggtgcaggatgacggcaccatgaaaattaaggatgaagaaagagacgatacgcttaccatcctgctcaaagccacactgctcgctgtttccggggtgtaccccatgtctatccctgcgaccctgtttgtctggtatttctggcaaaagaagaaacagagaagcggagtgctttgggacacaccctccccgcctgaagtcgagcgggccgtgctggatgacggcatttaccgcatcctgcagagaggcctcctggggcggtctcaggttggagtgggcgtcttccaagatggggtgtttcataccatgtggcacgttacacgcggagctgtgcttatgtatcagggcaagagactggagcccagctgggcctccgtcaaaaaggacctcattagctacgggggaggctggcggttccagggctcttggaacacgggggaagaggtccaggtgatcgccgttgaacctggcaagaatcccaagaacgtccaaaccacaccgggcacctttaagacccctgagggggaagtgggagctattgccctggacttcaaacccggcacatccgggagccctatcgtgaatagagagggaaagattgtcggcctctacggcaacggggtggttacgacctctggaacatatgtgtccgcgatcgctcaggccaaagccagccaggagggccccctgcccgaaatcgaggatgaagtctttaagaaacgcaatcttaccattatggacctgcaccctgggtccggaaagacacggagatacctgccggctatcgtgcgcgaggccattaagcggaaactcagaaccctgatccttgcgcccacgcgcgttgtggcttctgaaatggccgaggccctgaagggcatgcctattcggtatcaaacaaccgctgtcaaaagcgagcataccgggagagaaatcgtggatctcatgtgccacgccacattcaccatgcgcctgctgtcccccgttcgggtgcctaactacaatatgatcattatggacgaggctcattttacagatcccgccagcatcgcggccagaggctatatttctacccgggtcggaatgggcgaagctgccgctatcttcatgacggccacacctccggggtccgtggaggcctttccccagagcaacgctgtgattcaggacgaagaacgcgatatccctgagagatcttggaatagcggatacgactggatcaccgatttccccggcaagacagtctggtttgttccttccattaaatctgggaacgacatcgcgaattgtctccggaagaacggaaagcgcgtgattcagcttagcagaaaaaccttcgatacggaatatcaaaagaccaaaaacaatgactgggactacgtggtcacaaccgatatctccgagatgggcgccaacttccgggctgacagagtgattgatccccgccggtgcctgaagccggttatcctgaaagacgggcctgaaagagtgattctcgccggccccatgcccgtcacagtggcctctgctgcccagcgccggggaagaatcggccgcaatcagaacaaggagggggatcagtacgtttatatgggacaacctctgaataacgacgaggatcacgcgcattggaccgaagctaagatgcttctggacaatatcaacacacccgagggcattatccctgccctctttgaaccggagcgggaaaagagcgccgctattgatggggagtacagactgcgcggagaggccagaaagaccttcgtggagctgatgcggcgcggcgacctccccgtctggctttcctataaagtggcgagcgaggggtttcagtactctgatagacggtggtgcttcgacggcgaacgcaataaccaggtcctggaggaaaatatggatgtggagatctggacgaaggagggagaacgcaagaagctgcggcctagatggctcgacgcccgcacatattccgaccccctggcccttcgggagtttaaagagttcgccgctggcagacgcagcgtttccggggatctgattctcgagatcggaaagctgcctcagcacctgaccctccgggcccaaaacgctcttgacaatctggtgatgctgcacaactctgaacagggcgggaaggcctacagacatgcgatggaggagctccccgataccatcgaaacactgatgcttctggccctcattgctgtgctgaccggaggcgtcacactgtttttcctcagcggcaaagggcttggaaagacgtccatcggcctgctgtgtgttaccgcctctagcgctctcctgtggatggcctccgtggagccgcactggattgccgctagcatcattcttgaatttttcctgatggtgctcctgatccctgagcccgaccggcagcgcacacctcaggataatcaactggcgtatgtcgtgatcgggctcctttttatgattctgaccgttgccgctaacgagatgggactgctcgaaacaaccaaaaaggacctgggcatcgggcatgtggccgccgagaaccaccagcacgctacgattcttgatgtcgacctgcatcccgcctctgcgtggaccctctacgccgtggctacaaccgtcatcacacctatgatgagacacaccattgaaaatacgacagccaacatctccctgaccgctattgccaatcaggcggccatcctgatgggactcgataaaggctggcccatcagcaagatggaccttggcgtgccgctgctggctctcgggtgctactctcaagttaaccctctgacacttaccgccgctgtgctgatgctcgtcgcccattatgctattatcggacccggcctgcaggccaaggcgacccgggaggcccagaaacgcacagctgccgggattatgaagaatcccacggtggatggaatcgttgctattgacctggatcctgtggtctacgacgccaaattcgaaaagcagctcggccaaatcatgcttctgatcctgtgtacctcccagattctcctgatgagaacaacctgggccctttgcgagagcatcacactggcgaccgggccgctcacgacactgtgggagggatctcccggcaaattttggaacaccaccattgctgtgagcatggccaatatcttccggggctcctatctggctggggccggactcgccttctctcttatgaaaagcctgggcgggggacgcagaggcacaggggctcagggagaaaccctgggcgagaagtggaaacggcagctcaaccaactgtccaagagcgaatttaatacatacaaacgctccggcattatggaggtggacagatctgaagccaaggaggggcttaaacggggagagacgaccaagcacgcggttagcagaggcacagccaagctgcgctggttcgtcgaacggaacctcgtgaaacctgaggggaaggtgatcgatctgggatgtggcagagggggatggtcctattactgcgctggcctgaaaaaggtcaccgaagttaaaggctatacaaaagggggacccggccatgaggaacctatccccatggccacctacgggtggaatctcgtgaaacttcactctggaaaggacgtgtttttcatgcctccggagaagtgtgatacgctgctgtgcgacattggcgagagctcccccaaccctaccatcgaagaggggcgcacactccgggtcctgaaaatggtggaaccctggcttagaggaaatcagttttgtattaagatcctgaacccttacatgccctctgttgtggagaccctcgagcagatgcagcgcaaacacggcggcatgctggtccggaatccgctgagcagaaactccacacatgaaatgtattgggtgagctgcgggaccggaaatattgtttctgctgtgaacatgacatcccgcatgctcctgaaccggttcaccatggcccacagaaagcctacgtacgagcgcgatgtcgaccttggcgcggggacacggcatgtggccgtggaacccgaggtcgctaatctggatatcattggacaaagaatcgaaaacatcaaaaatgagcacaagagcacctggcactatgacgaggataacccctacaagacctgggcctatcatggctcttacgaagttaaaccttccgggagcgcttcttccatggtgaatggagtggtccgcctcctgacaaagccctgggacgtgattcctatggttacgcagatcgccatgaccgatacaaccccgtttggccagcaaagagtgttcaaagagaaggtcgacacacggacaccccgcgctaaaagaggcacagcccagattatggaagtgaccgcgaagtggctttgggggtttctgagccggaacaagaaacctagaatctgtacgcgggaggagttcacccgcaaggttagatccaatgccgctattggagccgtgtttgtcgacgagaaccagtggaatagcgctaaagaggccgtggaagatgagcggttctgggacctcgttcaccgcgaaagagagctgcataagcagggcaaatgcgccacatgcgtgtataacatgatggggaagcgggaaaagaaactgggagagtttggcaaggcgaaagggtctcgcgctatctggtacatgtggctcggcgccagattcctggagttcgaagcccttggatttatgaatgaggatcactggttcagccgggaaaactccctgtctggcgtcgagggggagggactccataagctgggctacatccttcgcgacattagcaaaatccccgggggaaatatgtatgctgatgacaccgccggctgggatacaagaattaccgaagacgatctgcaaaacgaggctaagatcacggacattatggaacctgagcacgccctcctggcgacatccatctttaaactgacctaccagaataaggtggtccgggtgcagcgccccgccaagaacgggacagttatggatgtgatctctagacgggaccagcgcggcagcggacaagtcggcacctatgggctcaacacgttcaccaatatggaagtgcagctgattagacagatggagtccgagggaatctttttcccgtctgaacttgagagccctaacctggctgaacgggtgctcgattggctggagaaacacggcgccgaaagacttaagcgcatggctatttccggggacgactgtgttgtgaaacccatcgatgaccggtttgccacagcgctgattgccctcaatgatatgggaaaggtcagaaaagacatccctcagtgggagcccagcaagggctggaacgattggcaacaggtgcctttctgctctcatcactttcatcagctgatcatgaaggacgggcgcgagattgttgtgccctgtcggaatcaggatgaactggtcggcagagctcgcgtgtcccaaggagccggctggagcctccgggagaccgcttgcctggggaaatcttacgcccagatgtggcagcttatgtatttccacagacgcgacctgcggctcgctgccaacgcgatctgttccgccgtcccggtggattgggttcctacaagcagaaccacatggtccattcacgctcatcaccaatggatgaccacggaagacatgctgtctgtgtggaatcgcgtctggatcgaggaaaacccctggatggaggataagacacatgtgagctcctgggaggaagttccctaccttggaaaacgggaggaccagtggtgcggcagcctgattgggctcaccgccagagccacctgggctacaaatatccaggtggccattaaccaggtccggagactgatcggaaatgaaaactatctggactacatgacctctatgaagcgctttaaaaatgagtccgatcctgagggcgcgctctggtga

SEQ ID NO: 18467 - RNA, 9879 nt, synthetic construct
  misc_feature 1..9879: note = derived and/or modified CDS sequence (opt5) from DENV-1__JX669470__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggatgtcctatgtgatgtgtacgggcagcttcaagctggagaaggaagtcgccgagacacagcacggaaccgtgcttgttcaggtgaaatacgagggcaccgatgcgccgtgcaagattcctttctctacacaagacgaaaaaggggtcacccagaacggaagactcatcacagctaatcccatcgtgacggataaggagaaacctgtgaacattgaaaccgagcccccctttggcgagtcctatatcgttgtcggggccggagaaaaggccctgaagctgagctggttcaaaaagggctctagcattgggaaaatgtttgaggctacagcccggggcgctagacgcatggccatcctcggagacaccgcgtgggatttcggctccattgggggagtgtttacatctgtgggcaagctggtccatcaggtgttcgggaccgcctacggagttctttttagcggcgtgtcctggacgatgaaaatcgggatcggcattctgctcacctggctgggactgaatagccggtctacatcccttagcatgacctgtatcgtcgtgggcatggttacactctacctgggggtgatggtccaggctgactctggatgcgtgattaactggaagggcagagaactgaagtgtgggtccggaatcttcgttaccaacgaggtgcacacatggaccgaacaatataaatttcaggccgatagccctaagcgcctctccgctgccattggccgggcgtgggaggagggggtctgcggcatcagatctgccacgcgcctggaaaatattatgtggaaacagatcagcaacgagcttaatcatatcctgctcgaaaacgacattaagttcacagtggtggtcggaaatgctaacggcatcctggcccaggggaaaaagatgattcggccgcaacccatggagcacaaatactcctggaagtcttggggaaaggctaaaatcattggcgccgacatccagaataccacctttatcattgatgggcctgacacacccgaatgtcctgatgagcagagagcctggaacatctgggaggttgaagactatggattcggcatttttaccacgaatatctggctgaagcttcgcgatagctacacacagatgtgcgaccaccggctcatgtccgctgcgattaaagatagcaaggccgtgcatgctgacatgggctattggatcgagtctgaaaaaaacgagacctggaagctggccagagcctccttcatcgaagtgaagacatgtatttggcccaaaagccacaccctgtggtctaatggggtcctcgagtccgagatgatcattccgaagatgtacggaggccctatcagccaacataactatcgccccgggtacttcacacagaccgctggaccttggcacctgggcaaacttgaactggattttgacctctgcgaggggacgaccgtggttgtggatgaacactgcggatctcggggccccagcctgagaacaaccacagtcaccggcaagattatccatgagtggtgttgccggtcctgtacgctgcctccccttcgcttcagaggggaggacggatgctggtacggcatggaaatccggccggtgaaagagaaggaagagaatctcgttagaagcatggtgtctgccgggtccggagaagtcgatagcttttccctgggcattctgtgtgtgtctatcatgattgaggaggttatgcgcagccggtggtccagaaagatgctcatgacagggaccctggcggtgttccttctgctcatcatgggacagctgacatggaacgacctgattcgcctttgcatcatggtcggcgctaatgcctctgacaaaatgggcatggggaccacctatctggccctcatggctacatttaagatgagacctatgttcgccgtgggactgctctttcggcgcctgacgagcagagaagtgcttctgctcaccattggcctgtccctggtcgcgtctgttgagcttcccaacagcctggaagagctcggggatggactggctatgggcatcatgatgctcaaactgcttacagaattccaaccccaccagctgtggaccacactcctgtccctgacctttatcaagacgacacttagcctggactacgcctggaaaaccaccgccatggtgctctctattgtgtccctgttccctctctgtctgagcacaacctctcagaagacaacgtggcttccggtcctgctggggtcctttggatgcaagcccctcaccatgttcctgatcacagagaacgagatttggggccggaaaagctggcctcttaatgaaggcatcatggctgtggggattgtttctatcctgctctccagcctgctcaagaacgatgtgcccctggccggacctcttatcgctggcgggatgctgattgcctgttatgtcatctccggaagctctgcggacctgagcctcgagaaagccgctgaagtgtcctgggaggaagaggccgagcattctggcaccagccacaatattctggttgaagtgcaggatgacgggacaatgaagatcaaagatgaggaacgcgacgatacccttacgattctgctcaaggctaccctgctcgccgtctccggagtgtaccccatgtctatccctgccacactgtttgtctggtatctttggcaaaaaaagaagcagagaagcggcgtgctgtgggacaccccctccccgcctgaggttgagcgggctgtgctggatgacggcatctaccgcattctccagagagggctgcttggacggtctcaggtcggcgtgggggttttccaagatggagtgttccatacaatgtggcacgtcacccgcggcgcggtgctgatgtatcaggggaaaagactcgaacccagctgggcctccgtgaagaaagacctgatcagctacggaggcggctggcggtttcaggggtcttggaacacaggagaggaagttcaggtcattgctgtggagcctggcaagaatcccaaaaacgtgcaaacgaccccggggacattcaagacccctgaaggagaggtcggcgccatcgccctcgactttaagcccgggacctccggaagccctattgtgaatagagagggcaaaatcgttggcctgtacgggaacggagtggtcacaacgtctggcacctatgtgtccgctattgcccaggcgaaggctagccaggaagggccccttcccgagatcgaagatgaggttttcaaaaagcgcaatctgacaatcatggacctgcaccctggatccggcaaaacccggagatacctcccggccattgtgcgcgaagccatcaagcggaagctgagaacacttattctggctcccacccgcgtcgtggcctctgagatggcggaggctctcaaagggatgcctatccggtatcaaacgacagccgttaagagcgaacataccggcagagagattgtggatctgatgtgccacgccacctttacaatgcgcctgctctcccccgtccgggtgcctaactacaatatgatcatcatggacgaagctcatttcaccgatcccgccagcattgctgccagaggatatatctctacacgggtgggcatgggggaggcggccgctatttttatgaccgccacgcctccgggatccgtcgaagctttcccccagagcaacgccgttatccaggacgaggagcgcgatattcctgaaagatcttggaatagcggctacgactggatcacagattttcccgggaaaaccgtgtggttcgtgccttccatcaagtctggaaacgacattgccaattgtcttcggaaaaacggcaagcgcgtcatccagctgagcagaaagacatttgataccgagtatcaaaaaacgaagaacaatgactgggactacgtggttaccacagatatttccgaaatgggggctaacttccgggcggacagagtgatcgatccccgccggtgcctgaaaccggtcattctcaaggacggccctgagagagtgatcctggccggacccatgcccgttaccgtggcttctgccgcccagcgccggggcagaattgggcgcaatcagaacaaagagggagatcagtacgtctatatgggccaacctcttaataacgacgaagatcacgctcattggacagaggccaagatgctgctcgacaatatcaacacccccgaagggatcattcctgcgctgttcgagccggaacgggagaagagcgctgccatcgatggagagtacagactgcgcggcgaagccagaaaaacatttgtggagctcatgcggcgcggggaccttcccgtctggctgtcctataaggtggctagcgaaggcttccagtactctgatagacggtggtgctttgacggagagcgcaataaccaggttctggaagagaatatggatgtggagatttggaccaaagaaggcgagagaaagaaactccggcctagatggctggacgcccgcacgtattccgacccccttgcgctgcgggaattcaaggagtttgccgctgggagacgcagcgtgtccggagatctcatcctggaaattggcaaactgcctcagcacctcacacttcgggcccaaaacgctctggacaatctggtcatgctccacaactctgagcaggggggaaaggcctacagacatgctatggaggaactgcccgataccatcgagacccttatgctgctcgccctgatcgcggttctgacaggcggcgtgaccctcttctttcttagcgggaagggactgggcaaaacatccattgggctgctctgtgtgacggcctctagcgctctgctttggatggcctccgtcgaaccgcactggatcgctgccagcattatcctggagttctttctcatggtgctgctgattcctgagcccgaccggcagcgcacccctcaggataatcaactcgcctatgttgtgatcggacttctgttcatgatcctgacagtcgctgcgaacgaaatgggcctcctggagaccacaaagaaagaccttgggattggacatgtggccgctgaaaaccaccagcacgccaccatgctggatgtcgacctccatcccgcctctgcttggacgctgtacgccgtggcgaccacagttatcacccctatgatgagacacacaattgagaataccacggccaacatctccctgacagctattgccaatcaggctgccatcctcatgggccttgataagggctggcccattagcaaaatggacctgggggtgccgctgctcgcgctgggatgctactctcaagtcaaccctcttaccctgacagccgctgtgctcatgctggttgcccattatgctatcatcggccccgggctgcaggccaaggctacccgggaagcccagaagcgcaccgcggccggaattatgaaaaatcccacagtggatggcatcgtcgctattgacctcgatcctgtggtgtacgacgccaagtttgagaaacagcttgggcaaatcatgctgctgattctctgtacgtcccagatcctgcttatgagaaccacatgggctctgtgcgagagcatcaccctcgccacaggaccgctgaccacgctgtgggaaggctctcccggcaagttctggaacacaaccattgccgttagcatggcgaatatctttcgggggtcctatctcgctggagccggccttgctttctctctgatgaaaagcctggggggaggccgcagagggaccggagcccagggcgagacactcggcgaaaagtggaagcggcagctgaaccaactttccaaaagcgagttcaatacctacaagcgctccgggattatggaagtcgacagatctgaggccaaagagggactgaagcggggcgaaacaacgaaacacgctgtgagcagagggaccgccaagctccgctggtttgtggagcggaacctggtcaagcctgaaggaaaagttatcgatctgggctgtgggagaggaggctggtcctattactgcgcgggcctcaagaaagtgacagaggtgaaggggtataccaaaggaggccccgggcatgaagagcctattcccatggccacatacggatggaatcttgtcaagctgcactctggcaaagacgtgttctttatgcctccggagaagtgtgataccctgctctgcgacatcggggaaagctcccccaaccctacgatcgaggaaggacgcaccctgcgggttcttaagatggtggagccctggctgagaggcaatcagttctgtattaaaatcctcaacccttacatgccctctgtcgtggagacactggaacagatgcagcgcaagcacggcgggatgctggttcggaatccgctcagcagaaactccacccatgagatgtattgggtgagctgcggaacaggcaatattgtctctgctgtgaacatgacctcccgcatgctgcttaaccggtttacaatggcccacagaaaacctacctacgaacgcgatgtggacctgggggctggaacgcggcatgtcgccgttgagcccgaagtggcgaatctcgatatcattggccaaagaatcgagaacattaagaatgagcacaaaagcacatggcactatgacgaagataacccctacaagacctgggcctatcatgggtcttacgaggtgaagccttccggaagcgcttcttccatggtcaatggcgtggttcgcctgcttaccaaaccctgggacgtgatccctatggtcacacagatcgccatgacggataccacaccgttcggccagcaaagagtgtttaaggaaaaagttgacacccggacaccccgcgctaagagagggaccgcccagattatggaggtgacagctaaatggctgtggggattcctcagccggaacaagaagcctagaatctgtacccgggaagagtttacgcgcaaagtcagatccaatgccgcgattggcgccgtgttcgttgacgagaaccagtggaatagcgctaaggaagccgtggaggatgaacggttttgggacctggtccaccgcgagagagaactgcataaacaggggaagtgcgctacctgcgtgtataacatgatgggaaaacgggagaagaagctcggcgagttcgggaaagccaagggctctcgcgccatctggtacatgtggctgggagcgagatttcttgaattcgaggctctgggcttcatgaatgaagatcactggtttagccgggagaactccctctctggggtcgagggagaaggcctgcataaacttgggtacattctgcgcgacatcagcaagatccccggaggcaatatgtatgccgatgacacagccgggtgggataccagaattacagaggacgatctccggaacgaagctaaaatcaccgacattatggagcctgaacacgccctgctggctacgtccatcttcaagctcacataccaaaataaagtggttcgcgtgcagagacccgccaagaacggcaccgtcatggatgtgatttctcggcgcgaccagagaggaagcggccaggtggggacatatggactgaacacctttacgaatatggaggttcaacttatccggcagatggagtccgaaggcatcttctttccgtctgagctggaaagccctaacctcgcggagagagtgctggattggcttgaaaagcacggggccgagcgcctgaaacggatggctatttccggagacgactgtgtcgtgaagcccatcgatgacagattcgccaccgctctcattgccctgaatgatatgggcaaagttcgcaaggacatccctcagtgggagcccagcaaagggtggaacgattggcagcaagtgcctttttgctctcatcacttccatcagctgattatgaaggacggccgggaaatcgtcgtgccctgtagaaatcaggatgagctcgtcggacgcgcgcgggtgtcccagggcgccgggtggagcctgagagaaacagcttgccttggaaagtcttacgcccaaatgtggcagctgatgtattttcaccgccgggacctcagactggctgccaacgctatctgttccgccgttccggtggattgggtccctaccagccgcacaacctggtccattcacgcgcatcaccagtggatgacaaccgaggacatgctttctgtgtggaatcgggtttggatcgaagagaacccctggatggaggataaaacgcatgtgagctcctgggaagaggtcccctacctgggcaagagagaagaccaatggtgcgggagcctcattggactgacagcccgggctacctgggccaccaatatccaggtggccattaaccaggtgagacgcctgatcggcaatgagaactatctcgactacatgacatctatgaaacggttcaagaatgagtccgatcctgaaggggctctgtggtga

SEQ ID NO: 18468 - RNA, 9879 nt, synthetic construct
  misc_feature 1..9879: note = derived and/or modified CDS sequence (opt5) from DENV-1__JX669471__SS-prME
  source 1..9879: mol_type = other RNA
agcgtgaccatgctgctgatgctgcttcccaccgccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaggaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagccgccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccaacggcatcctggctcaggggaaaaagatgattcggccgcaacccatggagcacaaatactcctggaagtcttggggaaaggccaaaatcattggcgccgacatccagaataccacatttatcattgatgggcctgacacccccgaatgtcctgatgagcagagagcttggaacatctgggaggtcgaagactatggattcggcatttttacgacaaatatctggctgaaacttcgcgatagctacacccagatgtgcgaccaccggctcatgtccgcggccattaaagatagcaaggctgttcatgccgacatgggctattggatcgagtctgagaagaacgagacatggaagctggccagagcttccttcatcgaagtgaagacctgtatttggcccaaaagccacacactgtggtctaatggggtgctcgagtccgagatgatcattccgaagatgtacggaggccctatcagccaacataactatcgccccgggtacttcacccagacggccggaccttggcacctgggcaaacttgaactggattttgacctctgcgaggggaccacagtcgtggttgatgaacactgcggatctcggggccccagcctgagaaccacaaccgtgacgggcaagattatccatgagtggtgttgccggtcctgtacactgcctccccttcgcttcagaggggaggacggatgctggtacggcatggaaatccggccggtcaaagagaaggaagagaatctcgtgagaagcatggtttctgcggggtccggagaagtggatagcttttccctgggcattctgtgtgtctctatcatgattgaggaggtgatgcgcagccggtggtccagaaagatgctcatgaccgggacactggctgttttccttctgctcatcatgggacagctgacctggaacgacctgattcgcctttgcatcatggtgggcgccaatgcctctgacaaaatgggcatggggaccacatatctggctctcatggccacgctgaagatgagacctatgtttgcggtcggactcctgttccggcgccttaccagcagagaagtgctgctcctgacaattggcctgtcccttgtggcttctgtcgagctgcccaacagcctcgaagaactgggggatggactcgccatgggcatcatgatgctgaaacttctgaccgaatttcaaccccaccagctctggacaaccctgctgtcccttacgttcatcaagacaaccctgagcctcgactacgcctggaaaaccacagctatggttctgtctattgtgtccctctttcctctgtgtcttagcaccacatctcagaagacgacctggctgccggtgctgctcgggtccttcggatgcaagcccctgacaatgtttcttatcaccgagaacgagatttggggccggaaaagctggcctctgaatgaaggcatcatggccattgggatcgtctctatcctcctgtccagcctcctgaagaacgatgtgccccttgctggacctctgattgccggcgggatgctgatcgcgtgttatgttatttccggaagctctgccgacctcagcctggagaaagctgccgaagtgtcctgggaggaagaggctgagcattctggcacaagccacaatatccttgtcgaagtgcaggatgacgggaccatgaagattaaagatgaggaacgcgacgatacgctgaccatcctcctgaaggccacactcctggccgtttccggagtgtaccccatgtctatccctgctacccttttcgtctggtatttttggcagaagaagaagcagagaagcggcgtgctgtgggacacaccctccccgcctgaggtcgagcgggcggtgctggatgacggcatttaccgcatcctccagagagggctgcttggacggtctcaggttggcgtgggggtcttccaagatggagtgttccataccatgtggcacgttacacgcggcgccgtgctgatgtatcaggggaaaagactcgaacccagctgggcttccgtcaagaaagacctgattagctacggaggcggctggcggtttcaggggtcttggaacacgggagaggaagtgcaagtgatcgccgttgagcctggcaagaatcccaaaaacgtccaaaccacaccggggaccttcaagacccctgaaggagaggtgggcgccattgctctcgactttaagcccgggacatccggaagccctatcgtgaatagagagggcaaaattgtcggcctgtacgggaacggagtggttacgacctctggcacatatgtgtccgccatcgcgcaggctaaggccagccaggaagggccccttcccgagatcgaagatgaggtcttcaaaaagcgcaatctgaccattatggacctgcaccctggatccggcaaaacacggagatacctcccggccatcgtgcgcgaagctattaagcggaagctgagaacccttatcctggcccccacgcgcgttgtggcgtctgagatggctgaggccctcaaagggatgcctattcggtatcaaacaaccgccgtcaagagcgaacataccggcagagagatcgtggatctgatgtgccacgctacatttaccatgcgcctgctctcccccgttcgggtgcctaactacaatatgatcattatggacgaagcccatttcacagtccccgctagcatcgccgcgagaggatatatttctacccgggtgggcatgggggaggccgctgccatctttatgacggctacacctccgggatccgtggaagccttcccccagagcaacgccgtcattcaggatgaggagcgcgacatccctgaaagatcttggaatagcggctacgattggatcaccgactttcccgggaaaacagtttggttcgtgccttccattaagtctggaaacgatatcgctaattgtcttcggaaaaacggcaagcgcgtgattcagctgagcagaaagacctttgacacggagtatcagaaaaccaagaacaatgattgggactacgtcgtgacaaccgacatctccgaaatgggggcgaacttccgggccgatagagttattgacccccgccggtgcctgaaaccggtgatcctcaaggatggccctgagagagtcattctggctggacccatgcccgtgacagttgcctctgccgctcagcgccggggcagaatcgggcgcaatcagaacaaagagggagaccagtacgtgtatatgggccaacctcttaataacgatgaagaccacgcccattggaccgaggcgaagatgctgctcgataatatcaacacacccgaagggattatccctgctctgttcgagccggaacgggaaaagagcgccgccattgacggagagtacagactgcgcggcgaagctagaaaaacctttgtcgagctcatgcggcgcggggatcttcccgtgtggctgtcctataaggtcgccagcgaaggcttccagtactctgacagacggtggtgctttgatggagagcgcaataaccaggtgctggaagagaatatggacgttgagatctggacgaaagaaggcgagagaaagaaactccggcctagatggctggatgcgcgcacatattccgacccccttgccctgcgggagttcaaggagtttgctgccgggagacgcagcgtgtccggagacctcattctggaaatcggcaaactgcctcagcacctcacccaacgggctcagaacgcccttgataatctggtgatgctgcacaactctgagcaagggggaaaggcttacagacatgccatggaggaactccccgacaccatcgagacactgatgcttctggcgctcattgccgtcctgaccggcggcgttacactgttctttctcagcgggaagggacttggcaaaacgtccatcgggctgctgtgtgtgaccgcttctagcgccctcctgtggatggcttccgtggaaccgcactggattgccgccagcatcattcttgagttctttctgatggtcctcctgatccctgagcccgatcggcagcgcacacctcaagacaatcagctggcttatgtggttatcggactccttttcatgattctgaccgtggcggccaacgaaatgggcctgctcgagacaaccaagaaagatctggggatcggacatgtcgctgccgaaaaccaccagcacgccacgatgcttgacgtggatctgcatcccgcttctgcctggaccctctacgcggtcgccacaaccgtgattacacctatgatgagacacaccatcgagaatacgacagctaacatttccctgaccgccatcgctaatcaagccgcgattctgatgggcctcgacaagggctggcccatcagcaaaatggatcttggggttccgctgctggccctcggatgctactctcaggtgaaccctctgacacttaccgctgccgtcctgatgctcgtggctcattatgccatcattggccccgggctgcaggctaaggccacccgggaagcgcagaagcgcacagccgctggaatcatgaaaaatcccacggttgacggcattgtggccatcgatctggaccctgtcgtgtacgatgctaagtttgagaaacaactcgggcagattatgcttctgatcctgtgtacctcccagatcctcctgatgagaacaacctgggccctttgcgagagcattacactggccaccggaccgctcacgacactgtgggaaggctctcccggcaagttctggaacaccaccatcgcggtgagcatggctaatatttttcgggggtcctatctggccggagctggcctcgccttctctcttatgaaaagcctcgggggaggccgcagagggacaggagcccagggcgagaccctgggcgaaaagtggaagcggcaactcaaccagctgtccaaaagcgagttcaatacatacaagcgctccgggatcatggaagttgacagatctgaggctaaagagggacttaagcggggcgaaacgaccaaacacgccgtcagcagagggacagcgaagctgcgctggtttgtggagcggaacctcgtgaagcctgaaggaaaagtcattgacctgggctgtgggagaggaggctggtcctattactgcgccggcctgaagaaagttaccgaggtgaaggggtatacaaaaggaggccccgggcatgaggaacctatccccatggctacctacggatggaatctcgtgaaacttcactctggcaaagatgtcttctttatgcctccggagaagtgtgacacgctgctgtgcgatatcggggaaagctcccccaaccctaccattgaggaaggacgcacactccgggtgctgaagatggttgagccctggcttagaggcaatcagttctgtatcaaaattctgaacccttacatgccctctgtggtcgagaccctcgaacagatgcaacgcaagcacggcgggatgctggtgcggaatccgctgagcagaaactccacacatgagatgtattgggttagctgcggaaccggcaatatcgtgtctgccgtcaacatgacatcccgcatgctcctgaaccggtttaccatggctcacagaaaacctacgtacgaccgcgatgtggaccttggggccggaacacggcatgtggcggtcgaacccgaggttgccaatctggatattatcggccagagaattgaaaacatcaagaatgagcacaaaagcacctggcactatgacgaggataacccctacaagacctgggcttatcatgggtcttacgaagtgaagccttccggaagcgcctcttccatggtgaatggcgtcgtgcgcctcctgacaaaaccctgggacgttatccctatggtgacgcagattgctatgaccgatacaaccccgttcggccaacagagagtctttaaggagaaagtggacacacggacaccccgcgccaagagagggacagctcagatcatggaagttaccgccaaatggctttggggattcctgagccggaacaagaagcctagaatttgtacgcgggaggaatttacccgcaaagtgagatccaatgcggccatcggcgctgtcttcgtggacgagaaccagtggaatagcgccaaggaggctgttgaagatgagcggttttgggacctcgtgcaccgcgaaagagagctgcataaacaagggaagtgcgccacatgcgtctataacatgatgggaaaacgggaaaagaagctgggcgagttcgggaaagccaagggctctcgcgcgatttggtacatgtggctcggagctagatttctggagttcgaagcccttggcttcatgaatgaggatcactggtttagccgggaaaactccctgtctggggtggagggagagggcctccataaactggggtacatccttcgcgacatcagcaagattcccggaggcaatatgtatgccgatgacaccgctgggtgggatacaagaatcaccgaagacgatctgcagaacgaggccaaaattacggacatcatggaacctgagcacgctctcctggccacatccattttcaagctgacctaccagaataaagtcgtgcgggttcagcgccccgcgaagaacggcacagtgatggatgtcatctctagacgggaccaacgcggaagcggccaggtggggacctatggactcaacacgtttaccaatatggaagtgcagctgatcagacagatggagtccgagggcattttctttccgtctgaacttgagagccctaacctggccgaacgggttctcgattggctggagaagcacggggctgaaagacttaaacgcatggccatctccggagacgactgtgtggtcaagcccattgatgaccggttcgctacagccctgatcgcgctcaatgatatgggcaaagtgagaaaggacattcctcaatgggagcccagcaaagggtggaacgattggcagcaggttcctttttgctctcatcacttccatcagctgatcatgaaggacggccgcgagatcgtggtcccctgtcggaatcaagatgaactggtgggcagagctcgcgtctcccagggagctgggtggagcctccgggagaccgcctgcctgggaaagtcttacgctcagatgtggcaacttatgtattttcacagacgcgacctgcggctcgccgctaacgccatttgttccgcggtgccggttgattgggtgcctacaagcagaaccacatggtccatccacgcccatcaccagtggatgaccacggaagacatgctgtctgtctggaatcgcgtgtggattgaggaaaacccctggatggaggataaaacacatgttagctcctgggaggaagtgccctaccttggcaagcgggaggaccagtggtgcgggagcctgatcggactcaccgctagagccacctgggccacaaatattcaggtcgctatcaaccaagtgcggagactgattggcaatgaaaactatctggactacatgacctctatgaaacgcttcaagaatgagtccgatcctgagggggccctctggtga

SEQ ID NO: 18469 - RNA, 9879 nt, synthetic construct
  misc_feature 1..9879: note = derived and/or modified CDS sequence (opt5) from DENV-1__JX669472__SS-prME
  source 1..9879: mol_type = other RNA
agcgtgaccatgctgctcatgctgcttcccacagctctggctttccacctcacgacccggggcggggagcctcatatgatcgtgtccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagccgccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacatgaagttcaccgtcgtggtgggaaatgccaacggcattctggctcaggggaaaaagatgatcaaaccgcaacccatggagcacaagtactcctggaagtcttggggaaaagccaagattatcggcgccgacattcagaataccacatttatcatcgatgggcctgacacccccgaatgtcctgatgagcagcgggcttggaacatttgggaggtcgaagactatggattcggcatctttacgacaaatatttggctgaaacttagagatagctacacccagatgtgcgaccaccgcctcatgtccgcggccatcaaggatagcaaagctgttcatgccgacatgggctattggattgagtctgaaaagaacgagacatggaagctggcccgggcttccttcatcgaagtgaaaacctgtatctggcccaagagccacacactgtggtctaatggggtgctcgagtccgagatgattatcccgaaaatgtacggaggccctattagccaacataactatagacccgggtacttcacccagacggccggaccttggcacctgggcaaacttgaactggattttgacctctgcgaggggaccacagtcgtggttgatgaacactgcggatctcgcggccccagcctgcggaccacaaccgtgacgggcaaaatcattcatgagtggtgttgcagatcctgtacactgcctccccttcggttccgcggggaggacggatgctggtacggcatggaaatcagaccggtcaaggagaaggaagagaatctcgtgcggagcatggtttctgcggggtccggagaagtggatagcttttccctgggcatcctgtgtgtctctattatgatcgaggaggtgatgagaagccgctggtcccggaaaatgctcatgaccgggacactggctgttttccttctgctcattatgggacagctgacctggaacgacctgatcagactttgcattatggtgggcgccaatgcctctgacaagatgggcatggggaccacatatctggctctcatggccacgtttaaaatgcgccctatgttcgcggtcggactgctctttagacggctgaccagccgcgaagtgcttctgctcacaatcggcctgtccctggtggcttctgtcgagcttcccaacagcctggaagaactgggggatggactggccatgggcattatgatgctcaagctgcttaccgagttccaaccccaccagctgtggacaaccctcctgtccctgacgtttatcaaaacaacccttagcctggactacgcctggaagaccacagctaccgttctctctatcgtgtccctgttccctctctgtctgagcacaacgtctcagaagaccacatggcttccggtgctgctggggtcctttggatgcaaacccctcaccatgttcctgattacagagaacaagatctggggcagaaaaagctggcctcttaatgagggcattatggccatcgggattgtctctatcctgctctccagcctgctcaagaacgatgtgcccctggctggacctcttatcgccggcgggatgctgattgcgtgttatgttatctccggaagctctgccgacctgagcctcgaaaaagctgccgaggtgtcctgggaagaggaagctgagcattctggcaccagccacaatattctggtcgaggtgcaggatgacgggacgatgaagatcaaagatgaagaacgggacgatacccttacaattctgctcaaggccaccctgctcgccgtttccggagtgtaccccatgtctatccctgctacactgtttgtctggtatttctggcaaaagaaaaagcagcgcagcggcgtgctttgggacaccccctccccgcctgaagtcgagagagcggtgctggatgacggcatctaccggattctgcagcgcgggctcctgggaagatctcaggttggcgtgggggtcttccaagatggagtgtttcatacaatgtggcacgttacgcggggcgccgtgcttatgtatcaggggaaacgcctggagcccagctgggcttccgtcaagaaagacctcatcagctacggaggcggctggagattccaggggtcttggaacaccggagaagaggtccaggtgattgccgttgaacctggcaagaatcccaagaacgtccaaacaaccccggggacctttaaaacacctgagggagaagtgggcgccatcgctctggacttcaagcccgggacgtccggaagccctattgtgaatcgggagggcaaaatcgtcggcctctacgggaacggagtggttaccacatctggcacctatgtgtccgccattgcgcaggctaaggccagccaggaggggcccctgcccgaaatcgaggatgaagtctttaaaaagagaaatcttacaatcatggacctgcaccctggatccggcaagacccgccggtacctgccggccattgtgagagaggctatcaaacgcaagctccggacgctgattcttgcccccacaagagttgtggcgtctgaaatggctgaggccctgaaagggatgcctatccgctatcaaaccaccgccgtcaagagcgagcatacaggccgggaaattgtggatctcatgtgccacgctaccttcacaatgagactgctgtcccccgttcgcgtgcctaactacaatatgatcatcatggacgaggcccattttaccgatcccgctagcattgccgcgcggggatatatctctacgagagtcggcatgggggaagccgctgccattttcatgacagctacccctccgggatccgtggaggcctttccccagagcaacgccgtgatccaggacgaagaacgggatattcctgagcgctcttggaatagcggctacgactggatcacagatttccccgggaaaaccgtctggtttgttccttccatcaagtctggaaacgacattgctaattgtctcagaaagaacggcaaacgggtgatccagcttagccgcaagacgttcgataccgaatatcagaagacaaagaacaatgactgggactacgtggtcaccacagatatttccgagatgggggcgaacttcagagccgaccgggtgatcgatcccagacgctgcctgaaaccggttattctgaaggacggccctgaacgggtgatcctcgctggacccatgcccgtcaccgtggcctctgccgctcagagacgcggccggattgggagaaatcagaacaaggagggagatcagtacgtttatatgggccaacctctgaataacgacgaggatcacgcccattggacagaagcgaaaatgcttctggacaatatcaacacccccgaggggatcattcctgctctctttgaaccggagcgcgaaaagagcgccgccatcgatggagagtaccggctgagaggcgaggctcgcaaaacgttcgtggaactgatgagaagaggggacctccccgtctggctttcctataaggtggccagcgagggctttcagtactctgatcgcagatggtgcttcgacggagaacggaataaccaggtcctggaggaaaatatggatgtggagatttggacaaaagagggcgaacgcaagaaactgagacctcggtggctcgacgcgagaacctattccgaccccctggcccttcgcgagtttaaggagttcgctgccgggcggagaagcgtttccggagatctgatcctcgagattggcaagctgcctcagcacctgaccctccgcgctcaaaacgcccttgacaatctggtgatgctgcacaactctgaacaagggggaaaggcttaccggcatgccatggaggagctccccgatacaatcgaaaccctgatgcttctggcgctcatcgccgtgctgacaggcggcgtcacgctgtttttcctcagcgggaagggacttggcaaaacctccattgggctgctgtgtgttacagcttctagcgccctcctgtggatggcttccgtggagccgcactggatcgccgccagcattatccttgaatttttcctgatggtgctcctgattcctgagcccgacagacagcggacccctcaggataatcaactggcttatgtcgtgatcggactcctttttatgatcctgacagttgcggccaacgagatgggcctgctcgaaaccacgaagaaagacctggggattggacatgtggctgccgagaaccaccagcacgccaccatgcttgatgtcgacctgcatcccgcttctgcctggacactctacgcggtggccaccacagtcatcacccctatgatgcgccacacgattgaaaatacaaccgctaacatctccctgacagccattgctaatcaggccgcgatcctgatgggcctcgataagggctggcccattagcaagatggaccttggggtgccgctgctggccctcggatgctactctcaagttaaccctctgacccttaccgctgccgtgctgatgctcgtcgctcattatgccatcatcggccccgggctgcaggctaaagccacaagagaggcgcagaagcggacggccgctggaattatgaaaaatcccaccgtggatggcatcgttgccattgacctggatcctgtggtctacgacgctaagttcgaaaaacagctcgggcaaatcatgcttctgattctgtgtacatcccagatcctcctgatgcgcaccacatgggccctttgcgagagcatcaccctggccacgggaccgctcacaaccctgtgggagggctctcccggcaagttttggaacaccacaattgcggtgagcatggctaatatcttcagagggtcctatctggccggagctggcctcgccttctctcttatgaaaagcctcgggggaggccggcgcgggaccggagcccagggcgaaacactgggcgagaaatggaagagacagctcaaccaactgtccaaaagcgaatttaatacgtacaagcggtccgggattatggaggtggaccgctctgaagctaaagagggacttaagagaggcgagaccacaaagcacgccgttagccgggggaccgcgaaactgagatggttcgtcgaacgcaacctcgtgaagcctgagggaaaagtgatcgatctgggctgtgggcggggaggctggtcctattactgcgccggcctgaagaaagtcacagaagttaaggggtataccaaaggaggccccgggcatgaggaacctattcccatggctacgtacggatggaatctcgtgaaacttcactctggcaaggacgtgtttttcatgcctccggagaaatgtgataccctgctgtgcgacatcggggagagctcccccaaccctacaatcgaagagggaagaaccctccgcgtcctgaagatggtggaaccctggcttcggggcaatcagttttgtattaaaatcctgaacccttacatgccctctgttgtggagacactcgagcagatgcagagaaagcacggcgggatgctggtccgcaatccgctgagccggaactccacccatgaaatgtattgggtgagctgcggaacaggcaatattgtttctgccgtgaacatgacctccagaatgctcctgaaccgcttcacgatggctcaccggaaacctacatacgagagagatgtcgaccttggggccggaacccgccatgtggcggtggaacccgaggtcgccaatctggatatcattggccaacggatcgaaaacattaagaatgagcacaagagcacctggcactatgacgaggataacccctacaaaacatgggcttatcatgggtcttacgaagttaagccttccggaagcgcctcttccatggtgaatggcgtggtcagactcctgacgaaaccctgggacgtgatccctatggttacccagatcgctatgacagataccacaccgtttggccagcaacgcgtgttcaaggagaaagtcgacaccagaacaccccgggccaagcgcgggaccgctcagattatggaagtgacggccaagtggctttggggatttctgagcagaaacaaaaagcctcggatctgtaccagagaggagttcacacggaaagttcgctccaatgcggccattggcgctgtgtttgtcgacgagaaccagtggaatagcgccaaggaggctgtggaagatgagagattctgggacctcgttcaccgggaacgcgagctgcataaacaggggaagtgcgcgacctgcgtgtataacatgatgggaaagagagagaagaagctgggcgagtttgggaaagccaagggctctcgggccatctggtacatgtggctcggagctcgcttcctggagttcgaagcccttggctttatgaatgaggatcactggttcagcagagaaaactccctgtctggggtcgagggagagggcctccataaactggggtacattcttcgggacatcagcaagatccccggaggcaatatgtatgccgatgacacagctgggtgggatacccgcattacggaagacgatctgcaaaacgaggccaaaatcacagacattatggaacctgagcacgctctcctggccacctccatctttaagctgacataccagaataaggtggtcagagtgcagcggcccgcgaaaaacggcaccgttatggatgtgatttctcgcagagaccagcggggaagcggccaagtcgggacgtatggactcaacaccttcacaaatatggaagtgcagctgatccgccagatggagtccgagggcatctttttcccgtctgaacttgagagccctaacctggccgaaagagtgctcgattggctggagaagcacggggctgaacggcttaaaagaatggccatttccggagacgactgtgttgtgaagcccatcgatgaccgctttgctaccgccctgattgcgctcaatgatatgggcaaagtccggaaggacatccctcagtgggagcccagcaaggggtggaacgattggcaacaggtgcctttctgctctcatcactttcatcagctgattatgaaagacggcagagagatcgttgtgccctgtcgcaatcaggatgaactggtcggacgggccagagtgtcccaaggcgctgggtggagcctccgcgagacagcctgcctgggaaagtcttacgctcagatgtggcagcttatgtatttccaccggagagacctgcgcctcgccgctaacgccatctgttccgcggtcccggtggattgggttcctaccagccggacaacctggtccattcacgcccatcaccaatggatgacgacagaagacatgctgtctgtgtggaatagagtctggatcgaggaaaacccctggatggaggataaaacccatgtgagctcctgggaggaagttccctaccttggcaagcgcgaggaccagtggtgcgggagcctgattggactcaccgctcgggccacatgggccaccaatatccaggtggctattaaccaggtcagacggctgatcggcaatgaaaactatctggactacatgacatctatgaaaagatttaagaatgagtccgatcctgagggggccctctggtga

SEQ ID NO: 18470 - RNA, 9879 nt, synthetic construct
  misc_feature 1..9879: note = derived and/or modified CDS sequence (opt5) from DENV-1__JX669473__SS-prME
  source 1..9879: mol_type = other RNA
agcgtgaccatgctgcttatgctgcttcccacagctctggctttccacctgacgacccggggcggggagcctcatatgatcgtgtccaagcaggaacggggaaaatctctgctttttaagacaagcgctggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaatagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggccccttccagcgagatccagctgaccgactacggcgccctcacactggactgttctcccagaaccggccttgatttcaacgaaatggtgctgctcacaatgaaagagaagtcctggctggtccataaacagtggtttcttgacctgcctctcccctggaccagcggggcttccacgtctcaagagacatggaatcggcaggatctgctggtgaccttcaagacagcgcacgccaagaaacaggaagtcgtggttctcggaagccaagagggcgctatgcacaccgccctgaccggggccacagaaattcagacgtccggaaccacaaccatctttgctggccatcttaagtgccgcctgaaaatggacaagctcacactgaaagggaccagctatgtgatgtgtacgggctctttcaagctggagaaggaagtcgccgagacacagcacggaaccgtgcttgttcaggtgaaatacgagggcaccgatgcgccgtgcaagattcctttctccacacaagacgaaaaaggggtcacccagaacggaagactcatcacagctaatcccatcgtgacggataaggagaaacctgtgaacattgaaaccgagccgccctttggcgagagctatatcgttgtcggggccggagaaaaggccctgaagctgtcttggttcaaaaagggcagctccattgggaaaatgtttgaggctacagcccggggcgctagacgcatggccatcctcggagacaccgcgtgggatttcggctctattgggggagtgtttacaagcgtgggcaagctggtccatcaggtgttcgggaccgcctacggagttctcttttccggcgtgagctggacgatgaaaatcgggatcggcattctgctcacctggctgggactcaattctcggtccacaagcctttctatgacctgtatcgctgtcggcatggtgacactctacctgggggttatggtgcaggccgactccggatgcgtcattaactggaagggcagagaactgaagtgtgggagcggaatcttcgtgaccaacgaggttcacacatggaccgaacaatataaatttcaggctgattcccctaagcgcctctctgccgcgattggccgggcctgggaggagggggtgtgcggcatcagaagcgctacgcgcctggaaaatattatgtggaaacagatctccaacgagcttaatcatatcctgctcgaaaacgacatgaagttcacagtcgtggtgggaaatgccaacggcattctggctcaggggaaaaagatgatcaaaccgcaacccatggagcacaagtactcttggaaaagctggggaaaggccaagattatcggcgccgacattcagaatgctacctttatcatcgatgggcctgacacccccgaatgtcctgatgagcagcgggcgtggaacatttgggaggtcgaagactatggattcggcatctttacaaccaatatttggctgaaacttagagattcctacacgcagatgtgcgaccaccgcctcatgagcgccgctatcaaggattctaaagccgttcatgccgacatgggctattggattgagtccgaaaagaacgagacatggaagctggctcgggccagcttcatcgaagtgaaaacctgtatctggcccaagtctcacacactgtggtccaatggggtgctcgagagcgagatgattatcccgaaaatgtacggaggccctatttctcaacataactatagacccgggtacttcacccagacagcgggaccttggcacctgggcaaacttgaactggattttgacctctgcgaggggaccacggtcgtggttgatgaacactgcggaagccgcggcccctccctgcggaccacaaccgtgacaggcaaaatcattcatgagtggtgttgcagaagctgtaccctgcctccccttcggttccgcggggaggacggatgctggtacggcatggaaatcagaccggtcaaggagaaggaagagaatctcgtgcggtctatggtttccgctgggagcggagaagtggattccttttctctgggcatcctgtgtgtcagcattatgatcgaggaggtgatgagatcccgctggtctcggaaaatgctcatgacggggacactggccgttttccttctgctcattatgggacagctgacctggaacgacctgatcagactttgcattatggtgggcgccaatgctagcgacaagatgggcatggggacaacctatctggccctcatggcgacctttaaaatgcgccctatgttcgctgtcggactgctctttagacggctgacatcccgcgaagtgcttctgctcacgatcggcctgtctctggtggccagcgtcgagcttcccaactccctggaagaactgggggatggactggccatgggcattatgatgctcaagctgcttaccgagttccaaccccaccagctgtggacaaccctcctgagcctgacatttatcaaaaccacgctttctctggactacgcttggaagacaaccgccaccgttctctccatcgtgagcctgttccctctctgtctgtctacaacctcccagaagacaacgtggcttccggtgctgctggggagctttggatgcaaacccctcaccatgttcctgattacagagaacaagatctggggcagaaaatcttggcctcttaatgagggcattatggctatcgggattgtctccatcctgctcagctccctgctcaagaacgatgtgcccctggccggacctcttatcgcgggcgggatgctgattgcctgttatgttatcagcggatctagcgctgacctgtccctcgaaaaagccgctgaggtgtcttgggaagaggaagccgagcatagcggcacctcccacaatattctggtcgaggtgcaggatgacgggacaatgaagatcaaagatgaagaacgggacgatacccttacgattctgctcaaggccaccctgctcgctgtttctggagtgtaccccatgagcatccctgcgacactgtttgtctggtatttctggcaaaagaaaaagcagcgctccggcgtgctttgggacaccccctctccgcctgaagtcgagagagccgtgctggatgacggcatctaccggattctgcagcgcgggctcctgggaagaagccaggttggcgtgggggtcttccaagatggagtgtttcatacaatgtggcacgttacccggggcgctgtgcttatgtatcaggggaaacgcctggagccctcctgggccagcgtcaagaaagacctcatctcttacggaggcggctggagattccaggggtcctggaacacaggagaagaggtccaggtgattgccgttgaacctggcaagaatcccaagaacgtccaaacgaccccggggacatttaaaacccctgagggagaagtgggcgctatcgccctggacttcaagcccgggaccagcggatctcctattgtgaatcgggagggcaaaatcgtcggcctctacgggaacggagtggttacaacgtccggcacctatgtgagcgcgattgctcaggccaaggcctcccaggaggggcccctgcccgaaatcgaggatgaagtctttaaaaagagaaatcttacaatcatggacctgcaccctggatctggcaagacccgccggtacctgccggctattgtgagagaggccatcaaacgcaagctccggacactgattcttgcgcccaccagagttgtggctagcgaaatggccgaggccctgaaagggatgcctatccgctatcaaacgacagctgtcaagtccgagcataccggccgggaaattgtggatctcatgtgccacgccaccttcacaatgagactgctgagccccgttcgcgtgcctaactacaatatgatcatcatggacgaggctcattttaccgatcccgcctctattgcggcccggggatatatctccacaagagtcggcatgggggaagctgccgctattttcatgaccgccacgcctccgggaagcgtggaggcctttccccagtctaacgctgtgatccaggacgaagaacgggatattcctgagcgcagctggaactccggctacgactggatcacagatttccccgggaaaaccgtctggtttgttccttctatcaagagcggaaacgacattgcgaattgtctcagaaagaacggcaaacgggtgatccagctttcccgcaagacattcgataccgaatatcagaagacgaagaacaatgactgggactacgtggtcaccacagatatttctgagatgggggccaacttcagagctgaccgggtgatcgatcccagacgctgcctgaaaccggttattctgaaggacggccctgaacgggtgatcctcgccggacccatgcccgtcaccgtggccagcgctgcccagagacgcggccggattgggagaaatcagaacaaggagggagatcagtacgtttatatgggccaacctctgaataacgacgaggatcacgcgcattggacagaagctaaaatgcttctggacaatatcaacacccccgaggggatcattcctgccctctttgaaccggagcgcgaaaagtccgccgctatcgatggagagtaccggctgagaggcgaggcccgcaaaacattcgtggaactgatgagaagaggggacctccccgtctggcttagctataaggtggcgtctgagggctttcagtactccgatcgcagatggtgcttcgacggagaacggaataaccaggtcctggaggaaaatatggatgtggagatttggaccaaagagggcgaacgcaagaaactgagacctcggtggctcgacgccagaacgtatagcgaccccctggcccttcgcgagtttaaggagttcgccgctgggcggagatccgtttctggagatctgatcctcgagattggcaagctgcctcagcacctgacactccgcgcccaaaacgctcttgacaatctggtgatgctgcacaacagcgaacaagggggaaaagcctaccggcatgcgatggaggagctccccgataccatcgaaaccctgatgcttctggccctcatcgctgtgctgacaggcggcgtcaccctgtttttcctctccgggaagggacttggcaaaacatctattgggctgctgtgtgttacggccagctccgctctcctgtggatggccagcgtggagccgcactggatcgccgcttctattatccttgaatttttcctgatggtgctcctgattcctgagcccgacagacagcggacccctcaggataatcaactggcgtatgtcgtgatcggactcctttttatgatcctgacagttgccgctaacgagatgggcctgctcgaaaccacaaagaaagacctggggattggacatgtggccgccgagaaccaccagcacgctaccatgcttgatgtcgacctgcatcccgcctccgcgtggacgctctacgccgtggctaccacagtcatcacccctatgatgcgccacacaattgaaaataccacggccaacatcagcctgacagctattgccaatcaggcggccatcctgatgggcctcgataagggctggcccatttctaagatggaccttggggtgccgctgctggctctcggatgctactcccaagttaaccctctgacccttacagccgctgtgctgatgctcgtcgcccattatgctatcatcggccccgggctgcaggccaaagcgaccagagaggcccagaagcggaccgctgccggaattatgaaaaatcccacagtggatggcatcgttgctattgacctggatcctgtggtctacgacgccaagttcgaaaaacagctcgggcaaatcatgcttctgattctgtgtacgagccagatcctcctgatgcgcaccacatgggccctttgcgagtctatcaccctggcgacaggaccgctcaccacgctgtgggagggcagccccggcaagttttggaacacaaccattgctgtgtccatggccaatatcttcagagggtcttatctggctggagccggcctcgccttcagccttatgaagtccctcgggggaggccggcgcgggaccggagctcagggcgaaacactgggcgagaaatggaagagacagctcaaccaactgagcaaatccgaatttaatacctacaagcggtctgggattatggaggtggaccgcagcgaagccaaagagggacttaagagaggcgagacaacgaagcacgcggtttcccgggggaccgccaaactgagatggttcgtcgaacgcaacctcgtgaagcctgagggaaaagtgatcgatctgggctgtgggcggggaggctggtcttattactgcgctggcctgaagaaagtcacagaagttaaggggtataccaaaggaggccccgggcatgaggaacctattcccatggccacatacggatggaatctcgtgaaacttcacagcggcaaggacgtgtttttcatgcctccggagaaatgtgataccctgctgtgcgacatcggggagtcctctcccaaccctacgatcgaagagggaagaaccctccgcgtcctgaagatggtggaaccctggcttcggggcaatcagttttgtattaaaatcctgaacccttacatgcccagcgttgtggagacactcgagcagatgcagagaaagcacggcgggatgctggtccgcaatccgctgtcccggaacagcacccatgaaatgtattgggtgtcttgcggaacaggcaatattgtttccgctgtgaacatgaccagcagaatgctcctgaaccgcttcacaatggcccaccggaaacctacctacgagagagatgtcgaccttggggcgggaacgcgccatgtggccgtggaacccgaggtcgctaatctggatatcattggccaacggatcgaaaacattaagaatgagcacaagtctacatggcactatgacgaggataacccctacaaaacctgggcctatcatgggtcctacgaagttaagcctagcggatctgcttccagcatggtgaatggcgtggtcagactcctgaccaaaccctgggacgtgatccctatggttacacagatcgccatgacggataccacaccgtttggccagcaacgcgtgttcaaggagaaagtcgacaccagaacaccccgggctaagcgcgggaccgcccagattatggaagtgacagcgaagtggctttggggatttctgtccagaaacaaaaagcctcggatctgtaccagagaggagttcacgcggaaagttcgcagcaatgccgctattggcgccgtgtttgtcgacgagaaccagtggaactctgctaaggaggccgtggaagatgagagattctgggacctcgttcaccgggaacgcgagctgcataaacaggggaagtgcgcgacctgcgtgtataacatgatgggaaagagagagaagaagctgggcgagtttgggaaagccaagggcagccgggctatctggtacatgtggctcggagcccgcttcctggagttcgaagcccttggctttatgaatgaggatcactggttctccagagaaaactctctgagcggggtcgagggagagggcctccataaactggggtacattcttcgggacatctccaagatccccggaggcaatatgtatgctgatgacacagccgggtgggatacccgcattacagaagacgatctgcaaaacgaggctaaaatcaccgacattatggaacctgagcacgccctcctggcgacgtctatctttaagctgacataccagaataaggtggtcagagtgcagcggcccgccaaaaacggcaccgttatggatgtgattagccgcagagaccagcggggatccggccaagtcgggacatatggactcaacaccttcacgaatatggaagtgcagctgatccgccagatggagtctgagggcatctttttcccgagcgaacttgagtcccctaacctggctgaaagagtgctcgattggctggagaagcacggggccgaacggcttaaaagaatggctattagcggagacgactgtgttgtgaagcccatcgatgaccgctttgccaccgcgctgattgccctcaatgatatgggcaaagtccggaaggacatccctcagtgggagccctctaaggggtggaacgattggcaacaggtgcctttctgctcccatcactttcatcagctgattatgaaagacggcagagagatcgttgtgccctgtcgcaatcaggatgaactggtcggacgggctagagtgagccaaggcgccgggtggtctctccgcgagacagcttgcctgggaaagtcctacgcccagatgtggcagcttatgtatttccaccggagagacctgcgcctcgctgccaacgcgatctgtagcgccgtcccggtggattgggttcctacctcccggacaacctggtctattcacgctcatcaccaatggatgacaaccgaagacatgctgagcgtgtggaatagagtctggatcgaggaaaacccctggatggaggataaaacgcatgtgtccagctgggaggaagttccctaccttggcaagcgcgaggaccagtggtgcgggtctctgattggactcacagcccgggccacctgggctaccaatatccaggtggccattaaccaggtcagacggctgatcggcaatgaaaactatctggactacatgacatccatgaaaagatttaagaatgagagcgatcctgagggggcgctctggtga

SEQ ID NO: 18471 - RNA, 9879 nt, synthetic construct
  misc_feature 1..9879: note = derived and/or modified CDS sequence (opt5) from DENV-1__JX669474__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggatgtcctatgtgatgtgtacgggcagcttcaagctggagaaggaagtcgccgagacacagcacggaaccgtgcttgttcaggtgaaatacgagggcaccgatgcgccgtgcaagattcctttctctacacaagacgaaaaaggggtcacccagaacggaagactcatcacagctaatcccatcgtgacggataaggagaaacctgtgaacattgaaaccgagcccccctttggcgagtcctatatcgttgtcggggccggagaaaaggccctgaagctgagctggttcaaaaagggctctagcattgggaaaatgtttgaggctacagcccggggcgctagacgcatggccatcctcggagacaccgcgtgggatttcggctccattgggggagtgtttacatctgtgggcaagctggtccatcaggtgttcgggaccgcctacggagttctttttagcggcgtgtcctggacgatgaaaatcgggatcggcattctgctcacctggctgggactgaatagccggtctacatcccttagcatgacctgtatcgctgtcggcatggtgacactctacctgggggttatggtgcaggccgactctggatgcgtcattaactggaagggcagagaactgaagtgtgggtccggaatcttcgtgaccaacgaggttcacacatggaccgaacaatataaatttcaggctgatagccctaagcgcctctccgccgcgattggccgggcctgggaggagggggtgtgcggcatcagatctgctacgcgcctggaaaatattatgtggaaacagatcagcaacgagcttaatcatatcctgctcgaaaacgacatgaagttcacagtcgtggtgggaaatgccaacggcattctggctcaggggaaaaagatgatcaaaccgcaacccatggagcacaagtactcctggaagtcttggggaaaagccaagattatcggcgccgacattcagaatgctacctttatcatcgatgggcctgacacccccgaatgtcctgatgagcagcgggcgtggaacatttgggaggtcgaagactatggattcggcatctttacaaccaatatttggctgaaacttagagatagctacacgcagatgtgcgaccaccgcctcatgtccgccgctatcaaggatagcaaagccgttcatgccgacatgggctattggattgagtctgaaaagaacgagacatggaagctggctcgggcctccttcatcgaagtgaaaacctgtatctggcccaagagccacacactgtggtctaatggggtgctcgagtccgagatgattatcccgaaaatgtacggaggccctaccagccaacataactatagacccgggtacttcacacagaccgcgggaccttggcacctgggcaagcttgaactggattttgacctctgcgaggggacgaccgtcgtggttgatgaacactgcggatctcgcggccccagcctgcggacaaccacagtgaccggcaaaattatccatgagtggtgttgcagatcctgtacgctgcctccccttcggttccgcggggaggacggatgctggtacggcatggaaattagaccggtcaaggagaaggaagagaatctcgtgcggagcatggtttctgctgggtccggagaagtggatagcttttccctgggcatcctgtgtgtctctatcatgattgaggaggtgatgagaagccgctggtcccggaaaatgctcatgacagggaccctggccgttttccttctgctcatcatgggacagctgacatggaacgacctgattagactttgcatcatggtgggcgccaatgcttctgacaagatgggcatggggaccacctatctggccctcatggcgacatttaaaatgcgccctatgttcgctgtcggactgctctttagacggctgacgagccgcgaagtgcttctgctcaccattggcctgtccctggtggcctctgtcgagcttcccaacagcctggaagagctcggggatggactggccatgggcatcatgatgctcaagctgcttacagaattccaaccccaccagctgtggaccacactcctgtccctgacctttattaaaacgacacttagcctggactacgcttggaagaccaccgccacagttctctctatcgtgtccctgttccctctctgtctgagcaccacatctcagaagacgacctggcttccggtgctgctggggtcctttggatgcaaacccctcacaatgttcctgatcaccgagaacgagatttggggcagaaagagctggcctcttaatgaaggcatcatggctattgggatcgtctctattctgctctccagcctgctcaaaaacgatgtgcccctggccggacctcttatcgcgggcgggatgctgatcgcctgttatgttatttccggaagctctgctgacctgagcctcgagaaggccgctgaagtgtcctgggaggaagaggccgagcattctggcacaagccacaatatcctggtcgaagtgcaggatgacgggaccatgaaaattaaggatgaggaacgggacgatacgcttaccatcctgctcaaagccacactgctcgctatttccggagtttaccccatgtctatccctgcgaccctgtttgtgtggtatttctggcaaaagaagaaacagcgcagcggcgtcctttgggacacaccctccccgcctgaggtggagagagccgtcctggatgacggcatctaccggattctgcagcgcgggctcctgggaagatctcaggtgggcgttggggtgttccaagatggagtctttcataccatgtggcacgtgacacggggcgctgttcttatgtatcaggggaagcgcctggaacccagctgggcctccgtgaaaaaggacctcatcagctacggaggcggctggagattccaggggtcttggaacacgggagaggaagtccaggtgattgccgtggagcctggcaaaaatcccaagaacgttcaaaccacaccggggacctttaagacccctgaaggagaggtcggcgctatcgccctggacttcaaacccgggacatccggaagccctattgtgaatcgggagggcaagatcgtgggcctctacgggaacggagtcgtgacgacctctggcacatatgtttccgcgattgctcaggccaaagccagccaggaagggcccctgcccgagatcgaagatgaggtgtttaagaaaagaaatcttaccatcatggacctgcaccctggatccggcaagacacgccggtacctgccggctattgtcagagaagccatcaagcgcaaactccggaccctgattcttgcgcccacgagagtggttgcttctgagatggccgaggccctgaaggggatgcctatccgctatcaaacaaccgctgtgaaaagcgaacataccggccgggagattgtcgatctcatgtgccacgccacattcaccatgagactgctgtcccccgtgcgcgttcctaactacaatatgatcatcatggacgaagctcattttacagatcccgccagcattgcggcccggggatatatctctaccagagtgggcatgggggaggctgccgctattttcatgacggccacacctccgggatccgtcgaagcctttccccagagcaacgctgtgatccaggacgaggagcgggatattcctgaacgctcttggaatagcggctacgactggatcaccgatttccccgggaagacagtgtggtttgtcccttccatcaaatctggaaacgacattgcgaattgtctcagaaagaacggcaagcgggttatccagcttagccgcaaaaccttcgatacggagtatcaaaagaccaaaaacaatgactgggactacgtggtgacaaccgatatttccgaaatgggggccaacttcagagctgaccgggtcatcgatcccagacgctgcctgaagccggtgattctgaaagacggccctgagcgggttatcctcgccggacccatgcccgtgacagtcgcctctgctgcccagagacgcggccggattgggagaaatcagaacaaggagggagatcagtacgtgtatatgggccaacctctgaataacgacgaagatcacgcgcattggaccgaggctaagatgcttctggacaatatcaacacacccgaagggatcattcctgccctctttgagccggaacgcgagaaaagcgccgctatcgatggagagtaccggctgagaggcgaagcccgcaagaccttcgttgagctgatgagacggggggacctccccgtgtggctttcctataaagtcgcgagcgaaggctttcagtactctgatcgcagatggtgcttcgacggagagcggaataaccaggtgctggaagagaatatggatgtcgagatttggacgaaggaaggcgagcgcaaaaagctgagacctcggtggctcgacgccagaacatattccgaccccctggctcttcgcgaatttaaagagttcgccgctgggcggagaagcgtgtccggagatctgatcctcgaaattggcaagctgcctcagcacctgaccctccgcgcccaaaacgctcttgacaatctggttatgctgcacaactctgagcaggggggaaaggcctaccggcatgcgatggaggaactccccgataccatcgagacactgatgcttctggccctcatcgctgtgctgaccggcggcgtgacactgtttttcctcagcgggaaaggacttggcaagacgtccattgggctgctgtgtgtcaccgcctctagcgctctcctgtggatggcctccgttgaaccgcactggatcgccgctagcattatccttgagtttttcctgatggtgctcctgattcctgagcccgacagacagcggacacctcaggataatcaactggcgtatgtggtcatcggactcctttttatgatcctgaccgtggccgctaacgaaatgggcctgctcgagacaaccaaaaaggacctggggattggacatgttgccgccgaaaaccaccagcacgctacgatgcttgatgtggacctgcatcccgcctctgcgtggaccctctacgccgtcgctacaaccgtgatcacacctatgatgcgccacaccattgagaatacgacagccaacatctccctgaccgctattgccaatcaggcggccatcctgatgggcctcgataaaggctggcccattagcaagatggaccttggggtcccgctgctggctctcggatgctactctcaagtgaaccctctgacacttaccgccgctgttctgatgctcgtggcccattatgctatcatcggccccgggctgcaggccaaggcgaccagagaagcccagaaacggacagctgccggaattatgaagaatcccacggtcgatggcatcgtggctattgacctggatcctgttgtgtacgacgccaaattcgagaagcagctcgggcaaatcatgcttctgattctgtgtacctcccagatcctcctgatgcgcacaacctgggccctttgcgagagcatcacactggcgaccggaccgctcacgacactgtgggaaggctctcccggcaaattttggaacaccaccattgctgtcagcatggccaatatcttcagagggtcctatctggctggagccggcctcgccttctctcttatgaagagcctggggggaggccggcgcgggacaggagctcagggcgagaccctgggcgaaaagtggaaaagacagctcaaccaactgtccaagagcgagtttaatacatacaaacggtccgggattatggaagtggaccgctctgaggccaaggagggacttaaaagaggcgaaacgaccaagcacgcggtgagccgggggacagccaagctgagatggttcgttgagcgcaacctcgtcaaacctgaaggaaaggtgatcgatctgggctgtgggcggggaggctggtcctattactgcgctggcctgaaaaaggtgaccgaggtcaaagggtatacaaagggaggccccgggcatgaagagcctattcccatggccacctacggatggaatctcgttaaacttcactctggcaaggacgtgtttttcatgcctccggagaagtgtgatacgctgctgtgcgacatcggggaaagctcccccaaccctaccatcgaggaaggaagaacactccgcgtgctgaaaatggtcgagccctggcttcggggcaatcagttttgtattaagatcctgaacccttacatgccctctgtggttgagaccctcgaacagatgcagagaaaacacggcgggatgctggtgcgcaatccgctgagccggaactccacacatgagatgtattgggtcagctgcggaaccggcaatattgtgtctgctgttaacatgacatccagaatgctcctgaaccgcttcaccatggcccaccggaagcctacgtacgaaagagatgtggaccttggggcgggaacacgccatgtcgccgtggagcccgaagtggctaatctggatatcattggccaacggatcgagaacattaaaaatgagcacaagagcacctggcactatgacgaagataacccctacaagacctgggcctatcatgggtcttacgaggtcaaaccttccggaagcgcttcttccatggttaatggcgtggtgagactcctgacaaagccctgggacgtcatccctatggtgacgcagatcgccatgaccgatacaaccccgtttggccagcaacgcgttttcaaagaaaaggtggacacaagaaccccccgggctaaacgcgggacagcccagattatggaggtcaccgcgaagtggctttggggatttctgagcagaaacaagaaacctcggatctgtacgagagaagagttcacccggaaggtgcgctccaatgccgctattggcgccgtttttgtggacgagaaccagtggaatagcgctaaagaagccgtcgaggatgaaagattctgggacctcgtgcaccgggagcgcgaactgcataagcaggggaaatgcgccacatgcgtttataacatgatgggaaagagagagaagaaactgggcgagtttgggaaggcgaaaggctctcgggctatctggtacatgtggctcggagcccgcttcctggaattcgaggcccttggctttatgaatgaagatcactggttcagcagagagaactccctgtctggggtggagggagaaggcctccataagctggggtacattcttcgggacatcagcaaaatccccggaggcaatatgtatgctgatgacaccgccgggtgggatacacgcattaccgaggacgatctgcaaaacgaagctaagatcacggacattatggagcctgaacacgccctcctggcgacatccatctttaaactgacctaccagaataaggtcgtgagagtccagcggcccgccaagaacggcacagtgatggatgttatttctcgcagagaccagcggggaagcggccaagtggggacctatggactcaacacgttcaccaatatggaggtccagctgatccgccagatggagtccgaaggcatctttttcccgtctgagcttgaaagccctaacctggctgagagagtgctcgattggctggaaaaacacggggccgagcggcttaagagaatggctatttccggagacgactgtgtggttaaacccatcgatgaccgctttgccacagcgctgattgccctcaatgatatgggcaaggtgcggaaagacatccctcagtgggagcccagcaaggggtggaacgattggcaacaggtccctttctgctctcatcactttcatcagctgattatgaaggacggcagagaaatcgtggttccctgtcgcaatcaggatgagctggtgggacgggctagagtctcccaaggcgccgggtggagcctccgcgaaaccgcttgcctgggaaaatcttacgcccagatgtggcagcttatgtatttccaccggagagacctgcgcctcgctgccaacgcgatctgttccgccgtgccggtcgattgggtgcctacaagccggaccacatggtccattcacgctcatcaccaatggatgaccacggaggacatgctgtctgtttggaatagagtgtggatcgaagagaacccctggatggaggataagacacatgtcagctcctgggaagaggtgccctaccttggcaaacgcgaagaccagtggtgcgggagcctgattggactcaccgcccgggccacctgggctacaaatatccaggttgccattaaccaggtgagacggctgatcggcaatgagaactatctggactacatgacctctatgaagagatttaaaaatgagtccgatcctgaaggggcgctctggtga

SEQ ID NO: 18472 - RNA, 9879 nt, synthetic construct
  misc_feature 1..9879: note = derived and/or modified CDS sequence (opt5) from DENV-1__JX669475__SS-prME
  source 1..9879: mol_type = other RNA
agcgtgaccatgctgctcatgctgcttcccaccgccctggctttccacctcacgaccagaggcggggagcctcatatgatcgtgtccaagcaggaacggggaaagtctctgctttttaagacaagcgccggcgttaatatgtgcaccctgattgcgatggacctcggggagctgtgtgaagatacaatgacctacaaatgcccccgcattacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaatagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagccgccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggcaaagcctgggaggagggggtgtgcggcatccggtctgctacaagactggaaaatattatgtggaagcagatcagcaacgagcttaatcatatcctgctcgaaaacgacattaaattcaccgtcgtggtgggaaatgccaacggcatcctggctcaggggaagaaaatgattcgcccgcaacccatggagcacaagtactcctggaagtcttggggaaaagccaagatcattggcgccgacatccagaataccacatttatcattgatgggcctgacacccccgaatgtcctgatgagcagcgggcttggaacatctgggaggtcgaagactatggattcggcatttttacgacaaatatctggctgaaacttagagatagctacacccagatgtgcgaccaccgcctcatgtccgcggccattaaggatagcaaagctgttcatgccgacatgggctattggatcgagtctgaaaagaacgagacatggaagctggcccgggcttccttcatcgaagtgaaaacctgtatttggcccaagagccacacactgtggtctaatggggtgctcgagtccgagatgatcattccgaaaatgtacggaggccctatcagccaacataactatagacccgggtacttcacccagacggccggaccttggcacctgggcaaacttgaactggattttgacctctgcgaggggaccacagtcgtggttgatgaacactgcggatctcgcggccccagcctgcggaccacaaccgtgacgggcaaaattatccatgagtggtgttgcagatcctgtacactgcctccccttcggttccgcggggaggacggatgctggtacggcatggaaatcagaccggtcaaggagaaggaagagaatctcgtgcggagcatggtttctgcggggtccggagaagtggatagcttttccctgggcattctgtgtgtctctatcatgattgaggaggtgatgagaagccgctggtcccggaaaatgctcatgaccgggacactggctgttttccttctgctcatcatgggacagctgacctggaacgacctgattagactttgcatcatggtgggcgccaatgcctctgacaagatgggcatggggaccacatatctggctctcatggccacgtttaaaatgcgccctatgttcgcggtcggactgagctttagacggctcacctcccgcgaagtgctgcttctgacaattggcctctctctggtggctagcgtcgagctgcccaactcccttgaagaactgggggatggactcgccatgggcatcatgatgctgaagctcctgaccgagttccaaccccaccagctttggacaaccctgctcagcctgacgtttatcaaaacaaccctgtctcttgactacgcctggaagaccacagctatggttctgtccattgtgagcctcttccctctgtgtctctctaccacatcccagaagacgacctggctgccggtgcttctggggagctttggatgcaaacccctgacaatgttcctcatcaccgagaacgagatttggggcagaaagtcttggcctctgaatgaaggcatcatggccattgggatcgtctccatccttctgagctccctcctgaaaaacgatgtgcccctcgctggacctctgattgccggcgggatgcttatcgcgtgttatgttattagcggatctagcgccgacctgtccctggagaaggctgccgaagtgtcttgggaggaagaggctgagcatagcggcacatcccacaatatcctcgtcgaagtgcaggatgacgggaccatgaaaattaaggatgaggaacgggacgatacgctgaccatccttctgaaagccacactcctggccgtttctggagtgtaccccatgagcatccctgctaccctctttgtctggtatttctggcaaaagaagaaacagcgctccggcgtgctgtgggacacaccctctccgcctgaggtcgagagagcggtgcttgatgacggcatttaccggatcctgcagcgcgggctgctcggaagaagccaggttggcgtgggggtcttccaagatggagtgtttcataccatgtggcacgttacacggggcgccgtgctgatgtatcaggggaagcgccttgaaccctcctgggctagcgtcaaaaaggacctgatttcttacggaggcggctggagattccaggggtcctggaacacgggagaggaagtccaggtgatcgccgttgagcctggcaaaaatcccaagaacgtccaaaccacaccggggacctttaagacccctgaaggagaggtgggcgccattgctctcgacttcaaacccgggacaagcggatctcctatcgtgaatcgggagggcaagattgtcggcctgtacgggaacggagtggttacgacctccggcacatatgtgagcgccatcgcgcaggctaaagcctcccaggaagggcccctccccgagatcgaagatgaggtctttagaaagcgcaatctgaccattatggaccttcaccctggatctggcaaaacacggagatacctgccggccatcgtgcgcgaagctattaagcggaagctgagaaccctcatcctggcccccacgcgcgttgtggcgagcgagatggctgaggcccttaaagggatgcctattcggtatcaaacaaccgccgtcaagtccgaacataccggcagagagatcgtggatctgatgtgccacgctacattcaccatgcgcctcctgagccccgttcgggtgcctaactacaatatgatcattatggacgaagcccattttacagatcccgcttctatcgccgcgagaggatatatttccacccgggtcggcatgggggaggccgctgccatcttcatgacggctacacctccgggaagcgtggaagcctttccccagtctaacgccgtgattcaggacgaggagcgcgatatccctgaaagaagctggaactccggctacgactggatcaccgatttccccgggaaaacagtctggtttgttccttctattaagagcggaaacgacatcgctaattgtctgcggaaaaacggcaagcgcgtgattcagctctccagaaagaccttcgatacggagtatcagaagaccaagaacaatgactgggactacgtggtcacaaccgatatctctgaaatgggggcgaacttccgggccgacagagtgattgatccccgccggtgccttaaaccggttatcctgaaggacggccctgagagagtgattctggctggacccatgcccgtcacagtggccagcgccgctcagcgccggggcagaatcgggcgcaatcagaacaaagagggagatcagtacgtttatatgggccaacctctcaataacgacgaagatcacgcccattggaccgaggcgaagatgctgcttgacaatatcaacacacccgaagggattatccctgctctgtttgagccggaacgggagaagtccgccgccattgatggagagtacagactccgcggcgaagctagaaaaaccttcgtggagctgatgcggcgcggggacctgcccgtctggctcagctataaggtggcctctgaaggctttcagtactccgatagacggtggtgcttcgacggagagcgcaataaccaggtccttgaagagaatatggatgtggagatctggacgaaagaaggcgagagaaagaaactgcggcctagatggctggacgcgcgcacatatagcgaccccctcgccctgcgggaatttaaggagttcgctgccgggagacgctccgtttctggagatcttattctggaaatcggcaaactccctcagcacctgaccctgcgggctcaaaacgccctcgacaatcttgtgatgctgcacaacagcgagcaagggggaaaggcttacagacatgccatggaggaactgcccgataccatcgagacactcatgctgcttgcgctgattgccgtgctcaccggcggcgtcacactgtttttcctgtccgggaagggactcggcaaaacgtctatcgggcttctgtgtgttaccgctagctccgccctgctctggatggctagcgtggaaccgcactggattgccgcctctatcattctggagtttttccttatggtgctgctcatccctgagcccgaccggcagcgcacacctcaggataatcaactggcttatgtcgtgatcggactgctctttatgattcttaccgttgcggccaacgaaatgggcctgctggagacaaccaagaaagacctcgggatcggacatgtggctgccgaaaaccaccagcacgccacgatgctggatgtcgaccttcatcccgcttccgcctggaccctgtacgcggtggccacaaccgtcattacacctatgatgagacacaccatcgagaatacgacagctaacattagcctcaccgccatcgctaatcaggccgcgattctgatgggcctggataagggctggcccatctctaaaatggacctcggggtgccgcttctggccctgggatgctactcccaagttaaccctctcacactgaccgctgccgtgcttatgctggtcgctcattatgccatcattggccccgggctccaggctaaggccacccgggaagcgcagaagcgcacagccgctggaatcatgaaaaatcccacggtggatggcattgttgccatcgacctggatcctgtggtctacgacgctaagttcgagaaacagctggggcaaattatgctccttatcctgtgtaccagccagatcctgctcatgagaacaacctgggccctgtgcgagtctattacacttgccaccggaccgctgacgacactctgggaaggcagccccggcaagttttggaacaccaccatcgcggtgtccatggctaatattttccgggggtcttatctggccggagctggcctggccttcagcctcatgaaatcccttgggggaggccgcagagggacaggagcccagggcgagaccctgggcgaaaagtggaagcggcagctgaaccaactcagcaaatccgagtttaatacatacaagcgctctgggatcatggaagtggacagaagcgaggctaaagagggactgaagcggggcgaaacgaccaaacacgccgtttccagagggacagcgaaacttcgctggttcgtcgagcggaacctggtgaagcctgaaggaaaagtgattgatctcggctgtgggagaggaggctggtcttattactgcgccggcctgaagaaagtcaccgaggttaaggggtatacaaaaggaggccccgggcatgaggaacctatccccatggctacctacggatggaatctggtgaagctccacagcggcaaagacgtgtttttcatgcctccggagaagtgtgatacgcttctgtgcgacatcggggaatcctctcccaaccctaccattgaggaaggacgcacactgcgggtcctcaagatggtggagccctggctgagaggcaatcagttttgtatcaaaattcttaacccttacatgcccagcgttgtggagaccctggaacagatgcagcgcaagcacggcgggatgctcgtccggaatccgctgtccagaaacagcacacatgagatgtattgggtgtcttgcggaaccggcaatatcgtttccgccgtgaacatgacaagccgcatgctgctcaaccggttcaccatggctcacagaaaacctacgtacgaacgcgatgtcgacctgggggccggaacacggcatgtggcggtggagcccgaagtcgccaatcttgatattatcggccaaagaattgagaacatcaagaatgagcacaaatctacctggcactatgacgaagataacccctacaagacctgggcttatcatgggtcctacgaggttaagcctagcggatctgcctccagcatggtgaatggcgtggtccgcctgctcacaaaaccctgggacgtgatccctatggttacgcagattgctatgaccgatacaaccccgtttggccagcaaagagtgttcaaggaaaaagtcgacacacggacaccccgcgccaagagagggacagctcagatcatggaggtgaccgccaaatggctgtggggatttctttcccggaacaagaagcctagaatttgtacgcgggaagagttcacccgcaaagttagaagcaatgcggccatcggcgctgtgtttgtcgacgagaaccagtggaactctgccaaggaagctgtggaggatgaacggttctgggacctggttcaccgcgagagagaactccataaacaggggaagtgcgccacatgcgtgtataacatgatgggaaaacgggagaagaagctgggcgagtttgggaaagccaagggcagccgcgcgatttggtacatgtggctgggagctagattcctcgagttcgaggccctgggctttatgaatgaagatcactggttctcccgggagaactctcttagcggggtcgagggagaaggcctgcataaactcgggtacatcctgcgcgacatctccaagattcccggaggcaatatgtatgccgatgacaccgctgggtgggatacaagaatcaccgaggacgatcttcaaaacgaagccaaaattacggacatcatggagcctgaacacgctctgctcgccacatctatttttaagctgacctaccagaataaagtggtccgggtgcagcgccccgcgaagaacggcacagttatggatgtgatcagcagacgggaccagcgcggatccggccaagtcgggacctatggactgaacacgttcaccaatatggaggtgcagctcatcagacagatggagtctgaaggcatctttttcccgagcgagctggaatcccctaaccttgccgagcgggtgctggattggctcgaaaagcacggggctgagagactgaaacgcatggccatcagcggagacgactgtgttgtgaagcccattgatgaccggtttgctacagcccttatcgcgctgaatgatatgggcaaagtcagaaaggacattcctcagtgggagccctctaaagggtggaacgattggcaacaggtgcctttctgctcccatcactttcatcagctcatcatgaaggacggccgcgaaatcgttgtgccctgtcggaatcaggatgagctggtcggcagagctcgcgtgagccaaggagctgggtggtctctgcgggaaaccgcctgcctcggaaagtcctacgctcagatgtggcagctgatgtatttccacagacgcgaccttcggctggccgctaacgccatttgtagcgcggtcccggtggattgggttcctacatccagaaccacatggtctatccacgcccatcaccaatggatgaccacggaggacatgctcagcgtgtggaatcgcgtctggattgaagagaacccctggatggaggataaaacacatgtgtccagctgggaagaggttccctacctgggcaagcgggaagaccagtggtgcgggtctcttatcggactgaccgctagagccacctgggccacaaatattcaggtggctatcaaccaggtccggagactcattggcaatgagaactatctggactacatgacctccatgaaacgctttaagaatgagagcgatcctgaaggggccctgtggtga

SEQ ID NO: 18473 - RNA, 9879 nt, synthetic construct
  misc_feature 1..9879: note = derived and/or modified CDS sequence (opt5) from DENV-1__JX669461__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattctcacacacagatgtgcgaccaccgcctgatgagcgccgctattaaggattccaaagcggttcatgccgacatgggctattggatcgaaagcgagaagaatgaaacctggaagctcgctcgggcctctttcatcgaggtgaaaacatgtatttggcccaagtcccacaccctgtggagcaacggggtgcttgaatctgagatggtcatcccgaaaatttacggaggccctatctcccaacataattatagacccgggtacttcacacagaccgccggaccttggcacctgggcaagctcgagctggattttgacctgtgcgaagggacgaccgtggttgtggatgagcactgcggataccgcggccccagccttcggacaaccacagtcaccggcaaaattatccatgaatggtgttgcagatcttgtacgctccctcccctgcggttccgcggggaggacggatgctggtatggcatggagatcagaccggtgaaggaaaaggaggaaaacctggttcggagcatggtgtccgctgggagcggagagatggactctttttccctcggcattctgtgtgtcagcatccttattgaagaggtgatgagatcccgctggtctcggaaaatgctgatgacagggaccctcgccgttttcctgctgcttatcatgggacagctgacatggaatgatctcattagactgtgcatcatggtgggcgcgaacgctagcgacaagatgggcatggggaccacctacctcgccctgatggccacacttaaaatgcgccctatgtttgctgtcggactgctcttcagacggctgacgtcccgcgaggtgctgcttctgaccgtgggcctctctctggtcgccagcgttgaactccccaattccctggaggaacttggggatggactggcgatgggcattatgatgctcaagctgctgacagactttcaaccccaccagctttggaccacactgctctctctgaccttcatcagaacgagcctctccctggattatgcttggaaaacaatggccatggcccttagcatcgtgtctctgtttcctctgtgtctctccaccaccagccagaagacaacctggctgccggtgcttctggggtctttcggatgcaagcccctcacaatgtttctgattacggagaacaaaatctggggccggaagtcctggcctattaacgaaggcatcatggctgtcgggattgtgagcatcctcctgtcttcccttctgaaaaatgacgttcccctggccggacctctcatcgctggcgggatgctgattgcctgttacgtgatcagcggatccagcgcggatctttctctggagaaggccgctgaggtcagctgggaagaggaagccgagcattccggcacctctcacaacattctcgtggaagttcaggacgatgggacaatgaaaatcaaggacgaggagcgcgatgacaccctgacaattctcctgaaagctacccttctggccgtgagcggagtctatcccatgtccatccctgccacgctgttcgtgtggtacttttggcaaaagaagaaacagagatctggcgtcctctgggatacccccagcccgcctgaagtggagcgggctgttctggacgacggcatctatcgcattcttcagagagggctgctcggacggtcccaggtgggcgtcggggtgttccaagatggagttttccatacaatgtggcacgtgacccgcggcgcggtcctgatgtaccaggggaagagactcgaaccctcttgggccagcgtgaaaaaggacctgatctcctacggaggcggctggcggtttcaggggagctggaatacaggagaggaggtgcaggttattgctgtcgaacctggcaaaaaccccaagaatgtgcaaaccacaccggggacgttcaagacccctgagggagaagtgggcgccatcgcccttgattttaaacccgggacatctggatcccctattgtcaacagagagggcaagatcgtgggcctgtatgggaatggagttgtgaccaccagcggcacatacgtctctgctattgcccaggcgaaagctacgcaggaagggcccctgcccgagatcgaggacgaagtgttcaagaaacgcaacctcaccatcatggatctgcaccctggatccggcaagacacggagatatcttccggccattgttcgcgaggccatcaagcggaaactgagaaccctcattctggctcccacacgcgtggtcgccagcgaaatggcggaggctctgaaggggatgcctatccggtaccaaaccacggccgtgaaatccgaacatacaggcagagagattgttgacctcatgtgccacgccacctttaccatgcgccttctgtctcccgtgcgggtccctaattataacatgatcatcatggatgaggctcatttcacagaccccgccagcattgctgccagaggatacatctccacccgggtgggcatgggggaagcggccgctatttttatgacagccacccctccgggaagcgtggaggctttcccccagtctaatgccgtcatccaggatgaagagcgcgacattcctgaaagatcctggaacagcggctatgattggatcacggactttcccgggaagacagtttggttcgtgccttctatcaaaagcggaaatgacattgccaactgtctgcggaagaatggcaagcgcgtgatccagctctccagaaaaacctttgatacagagtaccaaaagaccaaaaacaacgactgggattacgtcgtgacgaccgacatttctgagatgggggctaatttccgggcggatagagttatcgacccccgccggtgcctgaagccggtgattcttaaagaaggccctgagagagtcatcctggccggacccatgcccgtgacagttgctagcgccgcccagcgccggggcagaattgggcgcaaccagaataaggaaggagatcagtatatctacatgggccaacctctcaacaatgacgaggatcacgctcattggaccgaggccaagatgctgctggacaacatcaatacacccgaagggattatccctgcgctcttcgagccggaacgggagaaatccgctgccattgatggagaatatagacttcgcggcgaggccagaaagacctttgtggagctgatgcggcgcggggacctgcccgtctggctctcttacaaagtggctagcgaaggcttccagtattccgatagacggtggtgctttgacggagagcgcaacaatcaggtcctggaagagaacatggacgtggaaatctggacaaaggagggcgagagaaaaaagcttcggcctagatggctggatgcccgcacctacagcgaccccctcgcgctgcgggaattcaaagagtttgccgctgggagacgctctgtttccggagatctgattctcgaaatcggcaagcttcctcagcacctgacgctgcgggcccaaaatgctctcgacaacctggtgatgcttcacaatagcgagcaggggggaaaggcctatagacatgctatggaagagctgcccgatacaatcgagaccctcatgctgctggccctcattgcggtgcttaccggcggcgtcacactgttctttctgtccgggaaaggactcggcaagacctctatcgggctgctttgtgttatggccagctccgctctgctctggatggcctctgtggaaccgcactggattgctgccagcatcattctggagttctttctgatggtgctccttatccctgaacccgaccggcagcgcacacctcaggataaccaactggcctacgtcgtgatcggactgctcttcatgattctgacggttgctgcgaatgagatgggccttctggagaccacaaaaaaggacctcgggatcggacatgtggccgtcgaaaaccaccaccatgctaccatgctggatgtggacctgagacccgcctccgcctggacactctacgctgtcgccaccacggtgattacccctatgatgcggcacacaatcgagaacaccacagcgaatattagccttaccgccatcgctaaccaggccgctattctgatgggcctggataaaggctggcccatctctaagatggacatcggggttccgctcctggcccttggatgctattcccaggtgaatcctctgacgctcacagcggccgtcctgatgctggtggctcattacgccattatcggccccgggctccaagctaaggccacccgcgaagctcagaaaagaacagccgcgggaattatgaagaaccccaccgttgatggcatcgtgaccattgaccttgaccctgtcgtgtatgatgccaaatttgagaagcagctggggcagatcatgctgctcatcctgtgtacaagccaaattcttctgatgcggacgacctgggctctctgcgaatctatcacactggccaccggaccgctgacaaccctctgggagggctcccccggcaaattctggaatacgacaattgctgtgagcatggccaacatctttcgcgggtcttaccttgccggagcgggcctggctttcagcctgatgaagtccctcgggggaggcagacgggggaccggagcccagggcgagaccctgggcgaaaagtggaaacgccagcttaatcagctgtctaagagcgagttcaacacatataaaaagtccgggattatggaagttgacagaagcgaggctaaagaaggactcaagcggggcgagaccacaaagcacgccgtctccagagggacggccaaactgcgctggtttgtggagcggaatctggtgaagcctgaaggaaaagtcatcgatctcggctgtgggagaggaggctggtcttactattgcgctggccttaagaaagttaccgaggtgaaggggtacacaaaaggaggccccgggcatgaagagcctatccccatggccacctacggatggaacctggtgaagctgcacagcggcaaggacgtcttctttacacctccggaaaaatgtgataccctcctgtgcgacattggggagtcctctcccaatcctacgatcgaggaaggacgcacccttcgggtgctgaagatggttgagccctggctcagaggcaaccaattctgtattaaaatcctgaatccttatatgcccagcgtggtcgaaacactggagcagatgcagcgcaagcacggcgggatgctcgtgcggaacccgctgtccagaaattctacccatgagatgtactgggttagctgcggaacaggcaacattgtgtccgcggtcaatatgaccagccgcatgcttctgaaccggtttacaatggcccacagaaaacctacctatgaacgcgatgtggacctcggggctggaacgcggcatgtggccgtcgagcccgaagttgctaacctggatatcattggccagagaatcgagaatatcaagaacgaacacaagtctacatggcactacgacgaggataatccctataaaacctgggcctaccatgggtcctatgaggtgaagcctagcggatctgcgtccagcatggtgaacggcgtcgtgcgccttctgaccaaaccctgggacgttattcctatggtgacacaaatcgccatgacggacaccacaccgttcggccagcagagagtctttaaggaaaaagtggatacccggacaccccgcgctaagagagggaccgcccaaattatggaggttacagctaagtggctctggggattcctgtctcggaataaaaagcctagaatctgtacccgggaagagtttacgcgcaaagtgagatccaacgccgctattggcgccgtcttcgtggacgaaaatcagtggaacagcgcgaaggaggccgttgaggatgaacggttttgggacctggtgcaccgcgagagagaactccataaacaggggaagtgcgctacctgcgtctacaatatgatgggaaagcgggagaaaaagctgggcgaattcgggaaagccaagggctcccgcgctatctggtacatgtggcttggagccagatttctggagttcgaggccctcggcttcatgaacgaagatcactggtttagccgggagaattctctgagcggggtggaaggagagggccttcataaactggggtatatcctccgcgacatttccaagatccccggaggcaacatgtacgcggatgacacagctgggtgggataccagaattacagaggacgatctgcagaatgaagccaaaatcaccgacattatggagcctgaacacgccctgctcgctacgtctatcttcaagctgacatatcaaaacaaggtcgtgcgggttcagcgccccgccaaaagcggcaccgtgatggatgtcatctccagacgggaccagcgcggatctggccaggtggggacatacggacttaatacctttacgaacatggaggtgcaactgattagacagatggaaagcgagggcatcttctccccgtctgagctcgaaacccctaacctggctaagaaagttcttgactggctggagaagcacggggccgaacggctcaaaagaatggcgattagcggagatgactgtgtggtcaagcccatcgatgaccgctttgccacagctctgaccgccctgaatgatatgggcaaggtgcggaaagacattcctcagtgggagccctccaaggggtggaacgattggcagcaagttcctttctgcagccatcactttcatcagctcatcatgaaagacggcagagaaatcgtggtcccctgtcgcaatcaggatgagctggtgggacgggctagagtctctcagggcgccgggtggtcccttcgcgagacagcgtgcctgggaaagagctatgcccaaatgtggcagctcatgtacttccaccggagagacctgcgccttgctgccaacgctatttgttctgccgtgccggttgattgggtgcctacctcccggacaacctggagcatccacgctcatcaccagtggatgacgacagaagacatgctgtccgtctggaatagagtgtggattgaggaaaacccctggatggaggacaaaacccatgtttctagctgggaagaggtgccctatctcggcaagcgcgaggatcaatggtgcgggtccctgatcggactgaccgcccgggcgacatgggccaccaatattcaggtcgctatcaaccaggtgagacggctcattggcaatgaaaactacctggactacatgacaagcatgaagagatttaaaaatgagtctgatcctgaaggggccctttggtga

SEQ ID NO: 18474 - RNA, 9879 nt, synthetic construct
  misc_feature 1..9879: note = derived and/or modified CDS sequence (opt5) from DENV-1__KF184975__SS-prME
  source 1..9879: mol_type = other RNA
agcgtgaccatgctgctcatgctgatgcccacagcgcttgctttccacctgacgaccagaggcggggagcctcatatgatcgtctccaagcaggaacggggaaaatctctcctgtttaagaccagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccgaggaccagcatcaagttggcaatgaaacaaccgagcacgggacaatcgctaccattacgccccaggcccctaccagcgaaatccagctgacagactacggagccctgaccctcgattgttctccccggacaggcctggacttcaacgagatggtgcttctgaccatgaaggagaaatcctggctcgtccataagcagtggtttctggatcttcctctgccctggacgagcggcgcttccacatctcaagaaacctggaatcgccaggacctcctggtgacattcaaaaccgcgcacgccaagaagcaggaggtcgtggttctggggagccaagaaggagctatgcacaccgccctcacaggcgccacggagattcagacctccgggacaaccacaatctttgctggacatctgaaatgcagacttaagatggataaactgaccctcaagggcatgagctatgtgatgtgtacggggtctttcaaactggaaaaggaggtcgccgagacacagcacggcaccgtgctggttcaggtgaagtacgaaggaaccgacgcgccgtgcaaaattcctttctccatccaagatgagaagggcgtcatccagaacgggcggcttattacagctaatcccatcgtgaccgacaaagaaaagcctgtgaacattgagacagagccgccctttggagaaagctatatcgttgtcggcgccggggagaaaacgctcaagctgtcttggttcaagaaaggaagctccattggcaagatgtttgaagccaccgctagaggggcccgccggatggctatcctgggcgatacagcctgggacttcggatctatcggcggggtgtttaccagcgtgggaaaactcgtccatcaggtgttcggcacagcgtacggggttctgttttccggagtgagctggaccatgaagattggcatcgggattcttctgacgtggctcggcctcaattctagatccaccagcctgtctatgacatgtatcgccgtcggaatggtgaccctttacctcggcgttatggtgcaggctgattccgggtgcgtcattaactggaaaggacgcgagctgaagtgtggcagcgggatcttcgtgacaaatgaagttcacacctggacagagcaatataagtttcaggccgactcccctaaacggctgtctgctgccattggaaaggcgtgggaggaaggcgtgtgcgggatcagaagcgccacccgcctcgagaacgtcatgtggaaacagatctccaacgaactgaatcatattcttctggagaacgacatgaagttcacggtggtggtcggcgatgttaatggaatcctcgctcagggcaaaaagatggtgcggccgcaacccatggaacacaaatactcttggaaaagctgggggaaggccaagattatcggagctgacattcagaacacaacctttatcatcgatggccctgacacccccgagtgtcctgatgaccagagagcctggaatatttgggaggtggaagattatgggttcggaatctttacaaccaacatttggctgaagctgcgcgactcctacacgcagatgtgcgatcaccggcttatgagcgccgctatcaaagactctaaggcggtccatgccgatatgggctattggattgagtccgagaagaatgagacatggaagctcgctagagccagcttcatcgaagtgaagacctgtatctggcccaaatctcacacactgtggtccaacggcgttctggagagcgagatgattatcccgaagatttacgggggacctacctctcaacataattatcgccccggctacttcacacagaccgccgggccttggcacctcggaaaactggaacttgactttgatctgtgcgagggcacgaccgtggtcgtggacgaacactgcgggaaccggggacccagcctcagaacaaccacagttaccggcaagatcattcatgagtggtgttgccggtcctgtacgctgcctcccctgcgcttcaaaggcgaggacgggtgctggtacggaatggaaatcagaccggtgaaggagaaggaagagaatcttgtccggagcatggtgtctgctggctccggggaagttgataactttagcctcggactgctgtgtgtgtccatcatggtcgaggaggtgatgagatctcgctggagccggaaaatgctcatgacaggcaccctggccgtgttccttctgctcattatggggcagctgacatggaatgacctgatcagactttgcattatggtcggagcgaacgcttccgatcgcatgggcatgggcaccacctatctggccctcatggccacatttaagatgagacctatgttcgctgttgggctgctctttcggcgcctgacgtctagagaagtgcttctgctcaccatcggactgagcctggtggcctccgtcgagcttcccaattctctggaagaactgggcgacgggctggcgatgggaattatgatgctcaaactgcttacagatttccaaagccaccagctgtggaccacactcctgtccctgacctttgtgaagacgacacttagcctggactacgcttggaaaaccatggccatggttctctctatcgtgtccctgttccccctctgtctgagcaccacatctcagaagaccacatggcttcctgtcctgctgggctcctttgggtgcaagccgctcacgatgttcctgattaccgaaaacaaaatctggggacggaagtcctggccccttaacgagggcatcatggccgtgggcattgcttctatcctgctctccagcctgctcaaaaatgatgttcctctggccgggccccttattgctggaggcatgctgatcgcctgttatgtgatttccgggagctctgcggacctgagcctcgagaaggccgctgaagtctcctgggaggaagaggccgaacattctggagctagccacaacatcctggtggaggtccaggatgacggcacaatgaaaatcaaggatgaggaacgcgacgatacccttacaattctgctcaaagccaccctgctcgccgtgtccggggtttaccctatgtctatccccgctacgctgtttgtgtggtatttctggcaaaagaagaaacagagaagcggagtcctttgggacacccctagccctcccgaggcggaaaaggccgtgctggacgatggcatttaccggatcctgcagcgcggcctcctggggagatctcaggttggagtgggcgtcttccaagacggggtgtttcatacaatgtggcacgtgacccggggagctgttcttatgtatcagggcaaacgcgtcgagcccagctgggcctccgtgaagaaagatctgattagctacgggggaggctggagattccagggcctctggaatacaggggaggaagtgcaggtcatcgccgtggagcccggaaagaaccctcggaatgttcaaaccacacccggcacgtttaagaccccggaaggggaggtgggagctatcgccctggacttcaaacctggcacatctgggtcccccattgtcaacagagaaggaaagatcgtgggcctctacggcaatggggttgtgaccaccagcggaacatatgtctctgcgattgctcaggccaaagcctcccaggagggccctctgcccgagatcgaagatgaggtgtttcgcaagcggaaccttacgattatggacctgcaccccgggagcggaaaaaccagacgctacctgcctgctatcgttcgggaagccattaagagaaagctccgcacactgatccttgcgccgacccgggtggtcgcttccgagatggccgaagccctgaaaggcatgcccatcagatatcaaacaaccgctgtgaagacggagcatacagggcgcgagattgtggatctcatgtgccacgccaccttcaccatgcggctgctgtctcctgtcagagttcccaattacaacatgatcattatggacgaagctcattttacagatcctgccagcatcgcggcccggggctatatttccacccgcgtgggaatgggcgaggctgccgctatcttcatgacagccacaccccctgggagcatggaagcctttccgcagtctaatgctgtgatccaggacgaggaaagagatattcccgagcggtcctggaacagcggatacgactggatcacggacttccctggcaaaacagtctggtttgtgccctctattaagagcgggaatgatatcgcgaactgtctccgcaaaaatggaaagagagttattcagctttcccggaagaccttcgacacagagtatcagaaaaccaagaacaacgattgggactacgtggtcacgaccgatatctctgaaatgggcgccaatttcagagctgaccgcgtgatcgatcctcggagatgcctgaaacccgttattctgaaggacgggccggagcgcgtgatcctcgccggccctatgcccgtcacagtggccagcgctgcccagcggagaggacgcattggccggaaccagaataaagaaggggatcagtacgtctatatgggacaacccctgaacaatgacgaggatcacgcgcattggaccgaggctaagatgcttctggacaacatcaatacacctgaaggcattatccccgccctctttgagcctgaaagagagaagtccgccgctattgatggggaataccgcctgagaggagaggcccggaaaaccttcgtggagctgatgcgcagaggcgacctcccggtttggctttcttataaggtggcgagcgaagggtttcagtactccgaccggcgctggtgcttcgatggcgagagaaacaatcaggtgctggaagagaacatggacgtcgaaatctggacaaaagagggagagcggaagaaactgagaccccgctggctcgatgcccggacctatagcgaccctctggctcttagagaatttaaggagttcgccgctggccgccggtctgtttccggggatctgatcctcgaaattggaagactgccccagcacctgacgctcaaagcccaaaatgctcttgacaacctggtgatgctgcacaatagcgagcagggcgggaaggcctaccggcatgcgatggaggaactccctgatacaatcgagaccctgatgcttctggccctcattgctgtgctgaccggaggcgtcacactgtttttcctctccggcaaggggcttggaaaaacctctatcggcctgctgtgtgtgatggccagctccgttctcctgtggatggcttctgtggaaccccactggattgccgccagcatcatccttgagtttttcctgatggtcctcctgattccggaacctgaccgccagagaacaccccaggataaccaactggcttatgtggtcatcgggctcctttttattatcctgacggtggcggccaatgagatgggactgctcgagaccacaaagaaagacctgggcattgggcatgttgctgccgaagatcaccagcacgccaccatgcttgacgtggatctgcggcctgcttccgcctggacactctacgcggtcgccaccacgatcatcacccccatgatgcgccatacaattgagaacaccacagctaacatcagcctgaccgccattgctaatcaggccgcgatcctgatgggactcgacaagggctggcctatttctaaaatggacatcggcgtgccccttctggccctggggtgctactcccaagttaacccgctcacgctgacagctgccgtgcttatgctggtcgctcactatgccattatcggacctggcctccaggctaaggccaccagagaagcgcagaagcggacagccgctgggatcatgaaaaatcccaccgtggatggaattgtggccatcgacctggatcccgttgtctacgacaccaagttcgagaaacagctgggccaaattatgctccttatcctgtgtacaagccagattctgctcatgcgcacgacctgggctctgtgcgaatctatcacacttgccaccgggcctctgacaaccctctgggagggatccccgggcaagttttggaacacgacaatcgccgtgagcatggcgaatattttcagaggctcttatctggctggggccggactggctttcagcctcatgaaatcccttggcgggggacggcgcggcaccggggcccagggagagaccctgggcgaaaagtggaagagacagctgaaccaactctctaaaagcgagtttaatacatacaagcggtccggcatcaccgaagtggatagaagcgaggccaaagaagggctgaagcgcggagagacaacgaaacatgctgtctcccggggcgccgcgaaacttagatggttcgttgagcgcaacctggtgaagcccgaagggaaagtgattgacctcggatgtggcagagggggatggtcttattactgcgccggcctgaagaaagtcaccgaggtgaagggctatacaaaagggggacctggccacgaggagcccatccctatggctacctacgggtggaatctggttaagctccatagcggaaaagatgtgtttttcattccccctgaaaagtgtgacacacttctgtgcgatatcggcgagtcctctccgaaccccaccatcgaggaagggagaacgctgcgcgtcctcaagatggtggagccttggctgcggggaaatcagttttgtattaaaatccttaacccctacatgcctagcgttgtggaaaccctggagcagatgcagagaaagcacggcggcatgctcgtccgcaatcccctgtcccggaactctacacacgagatgtattgggtgagctgcgggaccggaaatattgtgtccgccgtcaacatgacaagcagaatgctgctcaatcgcttcaccatggctcatcggaaaccgacatacgaaagagacgttgatctgggcgccgggacccgccacgtggcggtggagcctgaagtcgccaaccttgacatcattggacaaagaatcgagaacattaagaatgaacataaatctacgtggcactatgacgaggataacccctacaagacatgggcttatcacggctcctacgaggtgaagcccagcgggtctgcctccagcatggttaatggagtggtccggctgctcaccaaaccttgggacgtgatccccatggttacccagatcgctatgacagatacgaccccttttggccagcaacgcgtgttcaaggaaaaagtcgacacaagaaccccgcgggccaagagaggcacagctcagattatggaggtgaccgccaaatggctgtgggggtttctttctcggaacaagaagccccgcatctgtacaagagaagagttcacccggaaagttcgctccaatgcggccattggagctgtgtttgtcgatgaaaaccagtggaatagcgccaaggaggctgtggaggacgaaagattctgggatctggtccatcgggagcgcgaactccacaaacagggcaagtgcgccacgtgcgtgtataacatgatggggaaaagagagaagaagctgggagaatttggcaaagccaaggggtcccgggcgatctggtacatgtggctgggcgctcgcttcctcgagttcgaggccctgggatttatgaatgaagaccattggttcagcagagagaactctcttagcggcgttgaaggggagggactgcacaaactcggctacattctgcgggatatctccaagatccctgggggaaatatgtatgccgacgataccgctggctgggacacacgcattaccgaggatgaccttcaaaacgaagccaaaatcacagacattatggagcccgaacatgctctgctcgccacctctatctttaagctgacgtaccagaataaagtggtcagagtgcagcggcctgccaagagcgggacagtgatggatgttatttcccgcagagaccagcggggctctggacaagtgggcacctatgggctgaacacattcaccaatatggaggtccagctcatcagacagatggaaagcgagggaatctttctgccctccgagcttgaaacgccgaacctggccgagcgcgctctcgattggctggaaaagcacggcgtggagcggcttaaaagaatggccatttctggggacgattgtgttgtgaagcctaccgacgatcgcttcgctacagccctgaccgcgctcaacgacatgggaaaagtccggaaggatatcccccagtgggaacctagcaaaggctggaatgactggcaacaggtgcccttttgctcccaccatttccaccagctgattatgaaggatgggagagagatcgtcgtgccttgtcgcaaccaggacgagctggttggccgggccagagtgagccaaggagctggctggtctctccgcgaaacagcctgcctggggaagtcctacgctcagatgtggcagcttatgtattttcatcggagagacctgcgcctcgccgctaatgccatttgtagcgcggtccccgtggattgggttccgacctctcggacaacctggtccatccacgcccaccatcaatggatgacgacagaggacatgctgagcgtgtggaacagagtctggatcgaagagaatccttggatggaagataaaacccacgtgtcctcttgggaggacgtgccctaccttggaaagcgggaggatcagtggtgcggcagcctgattgggctcaccgctagagccacatgggccaccaacatccaggttgctattaatcaggtccgccggctgatcggaaacgaaaattatctggactacatgacatccatgaaaagattcaagaacgagagcgatcccgaaggcgccctctggtga

SEQ ID NO: 18475 - RNA, 9879 nt, synthetic construct
  misc_feature 1..9879: note = derived and/or modified CDS sequence (opt5) from DENV-1__KT831765__SS-prME
  source 1..9879: mol_type = other RNA
agcgtgaccatgctgctcatgctgatgcccaccgcccttgctttccacctgacgaccagaggaggggaacctcatatgatcgtctccaagcaggaacgggggaaatctctcctgtttaagaccagcgccggcgttaacatgtgcacccttattgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagcacaaatactcttggaaaagctggggaaaggccaaaattatcggcgctgacgtgcagaataccacctttatcattgatgggcctaacacacccgaatgtcctgacgatcagagagcgtggaatatctgggaggtcgaggactatggattcggcatttttaccacgaacatctggctgaagctgcgcgattcctacacacaggtttgcgaccaccggcttatgagcgccgctattaaagattctaaggccgtgcatgccgacatgggctattggatcgaatccgagaaaaatgaaacctggaagctcgctagagccagcttcatcgaggtgaagacatgtatttggcccaaatctcacaccctgtggtccaacggggtcctggaaagcgagatgatcattccgaagatctacggaggccctatttctcaacataatcaccgccccgggtatttcacacagaccgcgggaccttggcacctcggcaaactggagcttgattttgacctgtgcgaagggacgaccgtggttgtggatgagcattgcggaaaccggggccccagcctcagaacaaccacagtcaccggcaagatcatccacgaatggtgttgccggtcctgtacgctgcctcccctgcgctacagaggggaggacggatgctggtacggcatggagattcggccggtgaaagaaaaggaggaaaatcttgttaagagcatggtgtctgctgggtccggagaggtcgacagcttctccctcggcctgctgtgtatctctattatgatcgaagaggtgatgagaagccgctggtcccggaaaatgctcatgacagggaccctggccgtctttttccttctgattatgggacagctcacatggaacgatctgatcagactgtgcattatggtgggcgccaatgcttctgaccgcatgggcatggggaccacctatcttgccctgatggcgacatttaagatgagacctatgttcgctgtcggactcctgtttcggcgcctcacgagcagagaggtgctgcttctgaccatcggcctctccctggtggcctctgtcgaactgcccaacagccttgaggaactgggggatggactcgccatgggcatcatgattctgaaactcctgacagacttccaatcccatcagctttgggctaccctgctcagcctgacatttatcaagaccacgttctctctgcactacgcctggaaaacaatggctatggttctttccattgtgagcctgtttcccctctgtctgtctaccacctcccagaagacaacctggctccctgtgctgcttgggagcctgggatgcaagccgctgacaatgttcctcatcgccgagaataaaatttggggccggaagtcttggcccctgaacgaaggcatcatggcggtcgggatcgtgtccattcttctgagctccctcctgaaaaacgatgttcctctcgccggacccctgatcgctggcgggatgcttattgcctgttatgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgcgacgataccctgacaatccttctgaaagccaccctcctggctgtgtctggagtctaccctctcagcattcccgccacactgtttgtgtggtatttctggcaaaagaagaaacagagatccggcgtcctttgggacaccccttctcccccggaagtggagcgggccgttctggatgacggcatctaccgcattatgcagagagggctgctcggacggagccaggtgggcgtcggggtgttccaagaaaacgtttttcacacgatgtggcatgtgacccgcggagctgtcctgatgtatcagggcaagagacttgagccttcctgggccagcgtgaaaaaggacctgatctcttacgggggaggctggcggctccagggctcctggaatacaggggaggaagtgcaggttattgcggtcgagcccggcaagaaccctaagaatgtgcaaaccgctcccggcacattcaagaccccggaaggggaggtgggagccatcgccctggattttaaacctggcacaagcgggtctcccattgtcaacagagaaggaaagatcgtgggcctctacggcaatggggttgtgacgacctccggaacatatgtcagcgctatcgcccaggcgaaggcttcccaggagggccctctgcccgagattgaagacgaggtgttccgcaagcggaaccttaccatcatggatctgcaccccgggtctggaaaaaccagacgctacctgcctgccattgttcgggaagccatcaagagaaagctccgcacactgattcttgctccgacgcgggtggtcgccagcgagatggctgaagccctgaaaggcatgcccatcagatatcaaaccacagcggtgaagtccgagcataccgggaaagagatcgttgacctcatgtgccacgccacatttaccatgcgcctgctgagccctgtgcgggtccccaattacaacatgattatcatggatgaagctcatttcacggacccttcttccattgccgctagaggctatatcagcacacgggtgggaatgggcgaggccgccgctatttttatgaccgcgacaccccctgggtctgtggaagccttcccgcagagcaatgctgtcatccaggatgaggaacgcgacatccccgagagatcctggaactctggatacgagtggattacagattttcctggcaagaccgtttggttcgtgcccagcatcaaatccgggaatgacattgccaactgtctccggaagaatggaaagcgcgtgatccagctttctagaaaaacatttgataccgaatatcaaaagacgaaaaacaacgactgggactacgtcgtgacaaccgatattagcgagatgggcgccaatttccgggctgacagagttatcgatcctcgccggtgcctgaagcccgtgattctgaaagacgggccggaaagagtcatcctcgccggccctatgcccgtgacagttgcgtccgctgcccagcgccggggaagaatcggccgcaaccacaataaggagggggatcagtacatttatatgggacagcccctgaacaatgacgaggatcacgcccattggaccgaagctaagatgcttctggacaacatcaatacgcctgagggcattatccccgccctcttcgaacctgagcgggaaaagagcgcggccattgatggggagtacagactgcgcggagaggctagaaagacctttgtggagctgatgcggcgcggcgacctcccggtctggctttcttataaagtggcctccgaggggttccaatacagcgatagacggtggtgctttgacggcgaacgcaacaatcaggtcctggaggaaaacatggatgtggagatctggacaaaggagggagaacgcaagaaactgcggcccagatggctcgacgctcgcacctattccgaccctctggcccttcgggagttcaaagaatttgctgccggcagacgctctgttagcggggatctgatcctcgagattggaaagctgccccagcacctgacacagcgggcgcaaaatgccctcgacaaccttgtgatgctgcataattccgaacagggcgggagagcttaccggcacgccatggaggagctgcctgataccatcgaaacactcatgctgcttgctctgattgccgtgctcaccggaggcgtcacgctgttctttctgtctggcaaggggctcggaaaaacaagcatcggccttctgtgtgttatggcctccagcgtgctgctctggatggcttctgtggagccccactggattgcggcctccatcatcctggagttctttcttatggtcctgctcattccggagcctgaccgccagagaacaccccaggataaccaactggcttatgtggttatcgggatgctgttcatgattctcaccgtggccgccaatgagatgggacttctggaaacaaccaagaaagacctgggcatcgggcatgtcgctgtggagaaccaccatcacgccgcgatgctcgatgtcgacctgcatcctgccagcgcttggacactttacgccgtggctacgaccattatcacacccatgatgcggcacaccattgaaaacacaaccgccaatatctctctgacggcgatcgccaaccaggctgccattctcatgggactggataagggctggcctatctccaaaatggacattggcgttcccctgctcgctcttgggtgctacagccaggtgaatccgctgaccctgacagccgctgtcctcatgctggtggcccactatgcgatcattggacctggccttcaagccaaggctacccgcgaggcccagaagagaacagctgccgggatcatgaaaaaccccaccgttgatggaatcgtggccattgacctggatcccgtcgtgtacgacgcgaagtttgaaaaacagctcggccagatcatgctgctgattctctgtacgtctcaaatccttctgatgcggacaacctgggctctgtgcgagagcattacactcgccaccgggcctctgaccacactttgggagggatccccgggcaagttctggaatacgaccatcgctgtgtctatggccaacatctttcgcggcagctatctggccggggctggactcgccttctccctgatgaaaagcctgggcgggggaagacggggcacaggggcgcagggagaaaccctcggcgagaagtggaagcgccagcttaatcagctgtccaaatctgagttcaacacatacaagagaagcggcattatggaggttgaccggtccgaagccaaagaggggctgaagagaggagagaccacgaaacatgctgtctctcgcggcacagccaagctccggtggtttgtggaaagaaatctggtgaagcccgaggggaaagtcatcgatcttggatgtggccgcgggggatggagctattactgcgctggcctgaagaaagttaccgaagtgaagggctataccaaagggggacctggccacgaggaacccattcctatggccacatacgggtggaacctcgtgaagctgcattccggaaaagacgtcttctttgtgccccctgagaagtgtgataccctgctctgcgacatcggcgagtctagcccgaatcccacaattgaagaggggcggacgcttagagttctgaagatggtggaaccttggctgcgcggaaaccaattctgtatcaaaattctcaatccctacatgccttccgtcgtggagaccctggagcagatgcagcggaagcacggcggcatgcttgttagaaaccccctgagccgcaattctacacacgaaatgtattgggtgtcctgcgggaccggaaacatcgtcagcgcgatcaatatgacatctcggatgctcctgaacagatttaccatggcccatcgcaaaccgacgtacgagcgggatgtggacctgggcgctgggaccagacacgtgacagtcgaacctgaggttgccaacctcgatattatcggacagcgcattgaaaatatcaagtgtgagcataaatccacctggcactatgacgaggataacccctacaagacatgggcttatcatggcagctacgaagtgaagccctctgggtccgccagctccatggtgaatggagtcgtgaaactgcttaccaagccttgggacgttattcccatggtgacacaaatcgctatgaccgatacgacacctttcggccagcagagagtctttaaagagaaggtggacacccggaccccgaaagccaagcgcggcacagcgcaaatcatggaagttacggccagatggctgtgggggttcctcagccggaacaagaaacccagaatttgcacccgggaggaatttacacgcaaggtgagatctaatgctgccatcggagctgtcttcgtggacgagaaccagtggaatagcgccaaagaggccgttgaagatgagcggttttgggacctggtgcaccgcgaaagagagcttcacaagcagggcaaatgcgcgacctgtgtctataacatgatggggaagcgggaaaagaaactgggagagttcggcaaggctaaagggtcccgcgccatttggtacatgtggctcggcgccagatttctggagttcgaagctctgggattcatgaatgaggatcattggttttctcgggaaaacagcctctccggcgtggagggggagggactgcacaaacttggctacatcctgcgcgacatttctaaaatcagcgggggaaatatgtatgccgatgacacagctggctgggataccagaatcacagaagacgatctccagaacgaggccaagattaccgaaatcatggagcctgaacatgcgcaactggccaaagctattttcaaacttacgtaccagaataaggtcgtgcgggttcagcgccccgccaaaaacgggaccgtgatggacgtcatctccagacgggatcagcgcggctctggacaagtgggcacatatgggctgaatacctttacaaacatggaggctcagctcattagacagatggagagcgaaggaatcttctcccctagcgagctggaaacccccaacctggccgagcgggtgctcgactggctggaaaagtacggcgttgagagacttaaacgcatggcgatctctggggatgactgcgtggtcaagccgattgacgatcggtttgccacggctctgacagccctcaatgacatgggaaaagtgagaaaggatatccctcagtgggagccctccaagggctggaacgactggcaacaggttcctttctgtagccaccactttcatcagctgattatgaaagatgggcgcgaaatcgtggtcccctgccggaatcaggacgagcttgtgggcagagctcgcgtctctcaaggagccggctggtccctgcgggaaaccgcttgtctcggaaagagctatgcccagatgtggcagctgatgtacttccacagacgcgatctgcggctcgcggccaacgctatttgctccgccgtgcctgttgactgggtgcccacatctagaaccacgtggagcatccatgcccaccatcaatggatgaccacagaggatatgctgtccgtctggaatcgcgtgtggattgaagagaacccgtggatggaggacaaaacccacatcagctcttgggaagatgttccttatcttggaaagcgggaggaccagtggtgtggctccctgatcgggctcacagctagagccacctgggcgacaaatattcaggtggctatcaaccaggtccggagactgattggaaatgaaaactaccttgactacatgaccagcatgaaacgctttaagaatgagtctgatcccgagggcgccctgtggtga

SEQ ID NO: 18476 - RNA, 9879 nt, synthetic construct
  misc_feature 1..9879: note = derived and/or modified CDS sequence (opt5) from DENV-1__KP188567__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctattcttcggaagctgtgcatcgaagccaaaatttctaataccacgacagactcccgctgtccgacccaaggagaggcgaccctcgtggaagagcaggatgccaacttcgtgtgcagacggacatttgtcgaccgcggctggggcaatgggtgtggactgttcggcaaggggagccttctgacctgcgctaagtttaaatgcgtgacaaagctcgagggaaaaatcgttcagtacgaaaacctgaagtattctgtgatcgtcacggtgcacaccggcgatcagcatcaagttgggaatgagacaaccgaacacggaacaattgccaccatcacgccccaggctcctacctccgagattcagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggccagcacatcccaagagacctggaatcggcaggatctgctggtgacattcaagaccgctcacgcgaagaaacaggaagtcgtggttctcggatctcaagagggcgccatgcacaccgctctgacaggggccacggaaatccagaccagcggaacaaccacaatttttgccggccatcttaagtgccgcctgaaaatggacaagctcaccctgaaagggatgtcctatgtgatgtgtacgggcagcttcaagctggagaaggaagtcgctgagacacagcacggaaccgtgcttgttcaggtgaaatacgagggcaccgatgccccgtgcaagatccctttcctcacacaagacgaaaaaggggtcacccagaacggaagactgatcacagcgaatcccattgtgacggataaggagaaacctgtgaacatcgaaaccgagcccccctttggcgagtcttatattgttgtcggggctggagaaaaggccctgaagctctcctggttcaaaaagggcagctctatcgggaaaatgtttgaggccacagctcggggcgccagacgcatggctattctgggagacaccgcctgggatttcggcagcatcgggggactttttacatccgtgggcaagctgatccatcaggtgttcgggaccgcgtacggagtcctcttttctggcgtgagctggacgatgaaaattgggatcggcattctgctgacctggcttggactcaattcccggagcacatctctgtccatgacctgtatcgccgttggcatggtgacactgtacctcggggtcatggtgcaggctgacagcggatgcgttattaactggaagggcagagaactgaagtgtgggtctggaatcttcgtgaccaacgaggtccacacatggaccgaacaatataaatttcaggccgattcccctaagcgccttagcgctgccattggcaaagcgtgggaggagggggtgtgcggcatccggtccgccacgagactggaaaatatcatgtggaagcagatttctaacgagctcaattacatcctgctggaaaacgacatgaaattcacagttgtggtcggagacgtgaatggcattcttgctcaggggaagaaaatgatcaagccgcaacccatggagcataagtatagctggaaatcctggggaaaggccaaaattatcggcgctgatatccagaacaccacctttattatcgacgggcctgatacacccgaatgtcctgacgatcagcgcgcctggaatatttgggaggtggaggactacggattcggcatctttaccacgaacatttggctcaagctgcgggattctcacacacagatgtgcgaccacagactgatgagcgccgctatcaaagattccaaggcggtccatgccgacatgggctattggatcgaaagcgagaagaatgaaacctggaaactcgctcgcgcctctttcattgaggttaagacatgtatctggcccaaatcccacaccctgtggagcaacggggtgcttgaatctgagatggtgattccgaagatctacggaggccctatttcccaacataattatcggcccgggtacttcacacagaccgccggaccttggcacctgggcaaactcgagctggattttgacctgtgcgaagggacgaccgtcgtggttgatgagcactgcggatacagaggccccagccttcgcacaaccacagtgaccggcaagatcatccatgaatggtgttgccggtcttgtacgctccctcccctgagattccggggggaggacggatgctggtatggcatggagattcgcccggtcaaggaaaaagaggaaaacctggtgagaagcatggtttccgctgggagcggagaggtggactctttttccctcggcatcctgtgtgtcagcattcttatcgaagaggtgatgcggtccagatggtctcgcaagatgctgatgacagggaccctcgccgttttcctgctgcttattatgggacagctgacatggaatgatctcatccggctgtgcattatggtgggcgcgaacgctctcgacagaatgggcatggggaccacctacctggcccttatggccacatttaaaatgcgccctatgttcgctgtcggactgctctttagacggctgacgagccgcgaggtgctgcttctgaccgtgggcctctccctggtcgcctctgttgaactccccagctccctggaggaacttggggatggactggcgatgggcatcatgatgctcaagctgctgacagacttccaaccccaccagctttggaccacactgctctctctgacctttatcagaacgagcctctccctggattatgcttggaaaacaatggccatggcccttagcattgtgtctctgttccctctgtgtctctccaccaccagccagaagacaacctggctgccggtgcttctggggtcttttggatgcaagcccctcacaatgttcctgatcacggagaataaaatttggggccggaagtcctggcctatcaacgaaggcattatggctgtcgggatcgtgagcatcctcctgtcttcccttctgaaaaacgacgttcccctggccggacctctcattgctggcgggatgctgatcgcctgttacgtgattagcggatccagcgcggatctttctctggagaaggccgctgaggtcagctgggaagaggaagccgagcattccggcacctctcacaatatcctcgtggaagttcaggacgatgggacaatgaaaattaaggacgaggagcgcgatgacaccctgacaatcctcctgaaagctacccttctggccgtgagcggagtctatcccatgtccatccctgccacgctgtttgtgtggtacttctggcaaaagaagaaacagagatctggcgtcctctgggatacccccagcccgcctgaagtggagcgggctgttctggacgacggcatttatcgcatccttcagagagggctgctcggacggtcccaggtgggcgtcggggtgttccaagatggagtttttcatacaatgtggcacgtgacccgcggcgcggtcctgatgtaccaggggaagagactcgaaccctcttgggccagcgtgaaaaaggacctgatttcctacggaggcggctggcggttccaggggagctggaacacaggagaggaggtgcaggttatcgctgtcgaacctggcaaaaatcccaagaacgtgcaaaccacaccggggacgtttaagacccctgagggagaagtgggcgccattgcccttgatttcaaacccgggacatctggatcccctatcgtcaatagagagggcaagattgtgggcctgtatgggaacggagttgtgaccaccagcggcacatacgtctctgctatcgcccaggcgaaagctacgcaggaagggaccctgcccgagatcgaggacgaagtgtttaagaaacgcaatctcacaattatggatctgcaccccggatccggcaagacccggagatatcttcctgccatcgttcgcgaggccattaagcggaaactgagaacactcatcctggctccgacccgcgtggtcgccagcgaaatggcggaggctctgaaggggatgcccattcggtaccaaacgacagccgtgaaatccgaacataccggcagagagatcgttgacctcatgtgccacgccaccttcacaatgcgccttctgtctcctgtgcgggtccccaactataatatgatcattatggatgaggctcattttaccgaccctgccagcatcgctgccagaggatacatttccacacgggtgggcatgggggaagcggccgctatcttcatgaccgccacgccccctggaagcgtggaggcttttccgcagtctaacgccgtcattcaggatgaagagcgcgacatccccgaaagatcctggaatagcggctatgattggatcacagacttccctgggaagaccgtttggtttgtgccctctattaaaagcggaaacgacatcgccaattgtctgcggaagaacggcaagcgcgtgattcagctctccagaaaaacattcgataccgagtaccaaaagacgaaaaataacgactgggattacgtcgtgaccacagacatctctgagatgggggctaacttccgggcggatagagttattgaccctcgccggtgcctgaagcccgtgatccttaaagaaggcccggagagagtcattctggccggacctatgcccgtgaccgttgctagcgccgcccagcgccggggcagaatcgggcgcaatcagaacaaggaaggagatcagtatatctacatgggccaacccctcaataacgacgaggatcacgctcattggacagaggccaagatgctgctggacaatattaacacccctgaagggatcattcccgcgctctttgagcctgaacgggagaaatccgctgccatcgatggagaatatagacttcgcggcgaggccagaaagacattcgtggagctgatgcggcgcggggacctgccggtctggctctcttacaaagtggctagcgaaggctttcagtattccgatagacggtggtgcttcgacggagagcgcaataaccaggtcctggaagagaatatggacgtggaaatttggaccaaggagggcgagagaaaaaagcttcggcccagatggctggatgcccgcacgtacagcgaccctctcgcgctgcgggaatttaaagagttcgccgctgggagacgctctgtttccggagatctgatcctcgaaatcggcaagcttccccagcacctgacactgcgggcccaaaacgctctcgacaatctggtgatgcttcacaacagcgagcaggggggaaaggcctatagacatgctatggaagagctgcctgataccattgagaccctcatgctgctggccctcatcgcggtgcttacaggcggcgtcaccctgtttttcctgtccgggaaaggactcggcaagacatctattgggctgctttgtgttatggccagctccgctctgctctggatggcctctgtggaaccccactggatcgctgccagcattatcctggagtttttcctgatggtgctccttatcccggaacctgaccggcagcgcacgccccaggataatcaactggcctacgtcgtgattggactgctctttatgatcctgaccgttgctgcgaacgagatgggccttctggagacaaccaaaaaggacctcgggattggacatgtggccgtcgaaaatcaccaccatgctacaatgctggatgtggacctgagacctgcctccgcctggaccctctacgctgtcgccacgaccgtgatcacacccatgatgcggcacaccattgagaacacaaccgcgaacatcagccttacggccattgctaatcaggccgctatcctgatgggcctggataaaggctggcctatctctaagatggacattggggttcccctcctggcccttggatgctattcccaggtgaacccgctgacactcaccgcggccgtcctgatgctggtggctcattacgccatcattggccctgggctccaagctaaggccacacgcgaagctcagaaaagaaccgccgcgggaatcatgaagaatcccaccgttgatggcattgtgacaatcgaccttgaccccgtcgtgtatgatgccaaattcgagaagcagctggggcagatcatgctgctcattctgtgtacgagccaaatccttctgatgcggaccacatgggctctctgcgaatctattaccctggccacaggacctctgaccacgctctgggagggctccccgggcaaattttggaacacaaccatcgctgtgagcatggccaatattttccgcgggtcttaccttgccggagcgggcctggctttcagcctgatgaagtccctcgggggaggcagacgggggaccggagcccagggcgagacactgggcgaaaagtggaaacgccagcttaaccagctgtctaagagcgagtttaatacctataaaaagtccgggatcatggaagttgacagaagcgaggctaaagaaggactcaagcggggcgagacaacgaagcacgccgtctccagagggaccgccaaactgcgctggttcgtggagcggaacctggtgaagcccgaaggaaaagtcatcgatctcggctgtgggagaggaggctggtcttactattgcgctggccttaagaaagttacagaggtgaaggggtacaccaaaggaggccctgggcatgaagagcccattcctatggccacatacggatggaatctggtgaagctgcacagcggcaaggacgtctttttcaccccccctgaaaaatgtgatacgctcctgtgcgacatcggggagtcctctccgaaccccaccattgaggaaggacgcacacttcgggtgctgaagatggttgagccttggctcagaggcaatcaattttgtatcaaaattctgaacccctatatgcctagcgtggtcgaaaccctggagcagatgcagcgcaagcacggcgggatgctcgtgcggaatcccctgtccagaaactctacacatgagatgtactgggttagctgcggaaccggcaatatcgtgtccgcggtcaacatgacaagccgcatgcttctgaatcggttcaccatggcccacagaaaaccgacgtatgaacgcgatgtggacctcggggctggaacacggcatgtggccgtcgagcctgaagttgctaacctggatattatcggccagagaatcgagaacattaagaatgaacacaagtctacctggcactacgacgaggataacccctataaaacctgggcctaccatgggtcctatgaggtgaagcccagcggatctgcgtccagcatggtgaatggcgtcgtgcgccttctgacaaaaccttgggacgttatccccatggtgacgcaaattgccatgaccgacacaaccccttttggccagcagagagtcttcaaggaaaaagtggatacacggaccccgcgcgctaagagagggacagcccaaatcatggaggttaccgctaagtggctctggggatttctgtctcggaacaaaaagcccagaatttgtacgcgggaagagttcacccgcaaagtgagatccaatgccgctatcggcgccgtctttgtggacgaaaaccagtggaatagcgcgaaggaggccgttgaggatgaacggttctgggacctggtgcaccgcgagagagaactccataaacaggggaagtgcgctacatgcgtctacaacatgatgggaaagcgggagaaaaagctgggcgaatttgggaaagccaagggctcccgcgctatctggtacatgtggcttggagccagattcctggagttcgaggccctcggctttatgaatgaagatcactggttcagccgggagaactctctgagcggggtggaaggagagggccttcataaactggggtatattctccgcgacatctccaagattcctggaggcaatatgtacgcggatgacaccgctgggtgggatacaagaatcaccgaggacgatctgcagaacgaagccaaaattacggacatcatggagcccgaacacgccctgctcgctacatctatctttaagctgacctatcaaaataaggtcgtgcgggttcagcgccctgccaaaagcggcacagtgatggatgtcatttccagacgggaccagcgcggatctggccaggtggggacctacggacttaacacgttcaccaatatggaggtgcaactgatcagacagatggaaagcgagggcattttttccccctctgagctcgaaacaccgaacctggctaagaaagttcttgactggctggagaagcacggggccgaacggctcaaaagaatggcgatcagcggagatgactgtgtggtcaagcctattgatgaccgcttcgccaccgctctgacagccctgaacgatatgggcaaggtgcggaaagacatcccccagtgggagccttccaaggggtggaatgattggcagcaagttcccttttgcagccatcacttccatcagctcatcatgaaagacggcagagaaattgtggtcccttgtcgcaaccaggatgagctggtgggacgggctagagtctctcagggcgccgggtggtcccttcgcgagaccgcgtgcctgggaaagagctatgcccaaatgtggcagctcatgtactttcaccggagagacctgcgccttgctgccaatgctatctgttctgccgtgcccgctgattgggttccgacatcccggaccacgtggagcattcacgcccatcaccagtggatgacaaccgaagacatgctgtccgtgtggaacagagtctggatcgaggaaaatccttggatggaggacaaaacccatgtgtctagctgggaagaggttccctatctcggcaagcgcgaggatcaatggtgcgggtccctgattggactgacagcgcgggccacctgggctacaaacatccaggtggccattaatcaggtcagacggctcatcggcaacgaaaattacctggactacatgacgagcatgaagagattcaaaaacgagtctgatcccgaaggggccctttggtga

SEQ ID NO: 18477 - RNA, 9879 nt, synthetic construct
  misc_feature 1..9879: note = derived and/or modified CDS sequence (opt5) from DENV-1__KP188568__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaatcatattctgctggaaaacgacatgaaattcacagtggtcgtgggagacgtgaatggcatccttgctcaggggaagaaaatgattcgcccgcaacccatggagcacaagtacagctggaagtcctggggaaaagccaagatcattggcgctgatatccagaacaccacctttatcattgacgggcctgatacacccgaatgtcctgacgatcagcgggcctggaatatctgggaggtcgaggactatggattcggcatttttaccacgaacatctggctcaaactgagagattctcacacacagatgtgcgaccatcgcctgatgagcgccgctattaaggattccaaagcggttcacgccgacatgggctactggatcgaaagcgagaagaatgaaacctggaagctcgctcgggcctctttcatcgaggtgaaaacatgtatttggcccaagtcccataccctgtggagcaacggggtgcttgaatctgagatggtcatcccgaaaatttatggaggccctatctcccaacacaattacagacccgggtatttcacacagaccgccggaccttggcacctgggcaagctcgagctggattttgacctgtgcgaagggacgaccgtggttgtggatgagcattgcggataccgcggccccagccttcggacaaccacagtcaccggcaaaattatccacgaatggtgttgcagatcttgtacgctccctcccctgcggttccgcggggaggacggatgctggtacggcatggagatcagaccggtgaaggaaaaggaggaaaacctggttcggagcatggtgtccgctgggagcggagagatggactctttttccctcggcattctgtgtgtcagcatccttattgaagaggtgatgagatcccgctggtctcggaaaatgctgatgacagggaccctcgccgttttctttctgctgatcatgggacagcttacatggaatgatctgattagactctgcatcatggtgggcgcgaacgctagcgaccgcatgggcatggggaccacctatctggccctcatggccacattcaagatgagacctatgtttgctgtcggactgcttttccggcgcctgacgtccagagaggtgctcctgctgaccgtgggcctttctctggtcgccagcgttgaactccccaattccctggaggaactcggggatggactggcgatgggcattatgatgcttaaactgctcacagactttcaaccccatcagctgtggaccacactgctttctctgaccttcatccggacgagcctctccctggattacgcttggaagacaatggccatggccctcagcatcgtgtctctgtttcctctttgtctgtccaccaccagccagaaaacaacctggctgccggtgctcctggggtctttcggatgcaagccccttacaatgtttctgattacggagaacaagatctggggccgcaaatcctggcctattaacgaaggcatcatggctgtcgggattgtgagcatcctcctgtcttccctcctgaagaatgacgttccccttgccggacctctgatcgctggcgggatgctgattgcctgttatgtgatcagcggatccagcgcggatctctctctggagaaagccgctgaggtcagctgggaagaggaagccgagcactccggcacctctcataacattcttgtggaagttcaggacgatgggacaatgaagatcaaagacgaggagagagatgacaccctgacaattctcctgaaggctaccctcctggccgtgagcggagtctaccccatgtccatccctgccacgcttttcgtgtggtatttctggcaaaaaaagaagcagcggtctggcgtcctgtgggatacccccagcccgcctgaagtggagcgcgctgttctggacgacggcatctacagaattctccagcgggggctgcttggacgctcccaggtgggcgtcggggtgtttcaagatggagttttccacacaatgtggcacgtgaccagaggcgcggtcctgatgtatcaggggaaacggctcgaaccctcttgggccagcgtgaagaaagacctgatctcctacggaggcggctggagatttcaggggagctggaatacaggagaggaggtgcaggttattgctgtcgaacctggcaagaaccccaaaaatgtgcaaaccacaccggggacgttcaagacccctgagggagaagtgggcgccatcgccctcgattttaagcccgggacatctggatcccctattgtcaaccgcgagggcaaaatcgtgggcctgtacgggaatggagttgtgaccaccagcggcacatatgtctctgctattgcccaggcgaaggctacgcaggaagggccccttcccgagatcgaggacgaagtgttcaaaaagcggaacctgaccatcatggatctgcatcctggatccggcaaaacaagacgctacctcccgagcattgttcgggaggccatcaagagaaagctgcgcacccttattctggcccccacacgggtggtcgcttccgaaatggccgaggcgctcaaagggatgcctatcagatatcaaaccacggctgtgaagtctgaacacacaggccgcgagattgttgacctgatgtgccatgccacctttaccatgcggctgctcagccccgtgagagtccctaattacaacatgatcatcatggatgaggcccacttcacagaccccgcttccattgccgctcggggatatatcagcacccgcgtgggcatgggggaagccgcggccatttttatgacagctacccctccgggatctgtggaggccttcccccagtccaatgctgccatccaggatgaagagagagacattcctgaacggagctggaacacgggctacgattggatcacagactttcccgggaaaaccgtctggttcgttccttctatcaagagcggaaatgacattgccaactgtcttcgcaaaaatggcaagagagtgatccagctgtcccggaagacattcgataccgagtatcaaaaaacgaagaacaacgactgggattacgtggtcaccacagacatttctgagatgggggctaattttagagcggatcgcgtgatcgacccccggagatgcctgaaaccggttattctcaaggaaggccctgagcgcgtgatcctggccggacccatgcccgtcaccgtggctagcgccgcccagcggagaggccgcattgggcggaaccagaataaagaaggagatcagtacatctatatgggccaacctcttaacaatgacgaggatcatgctcactggacagaggccaagatgctgctcgacaacatcaatacccccgaagggattatccctgcgctgttcgagccggaaagagagaagtccgctgccattgatggagaataccgcctgagaggcgaggcccggaaaacatttgttgagctcatgcgcagaggggaccttcccgtgtggctgtcttataaggtcgctagcgaaggcttccagtactccgatcggcgctggtgctttgacggagagagaaacaatcaggtgctggaagagaacatggacgtcgaaatctggaccaaagagggcgagcggaagaaactcagacctcgctggctggatgcccggacgtatagcgacccccttgcgctgagagaattcaaggagtttgccgctgggcgccggtctgtgtccggagatctcattctggaaatcggcaaactgcctcagcacctcacacttagagcccaaaatgctctggacaacctggttatgctccataatagcgagcaggggggaaaggcctaccggcacgctatggaagagctgcccgataccatcgagacccttatgctgctcgccctgattgcggtgctgacaggcggcgtgaccctcttctttctttccgggaagggactgggcaaaacatctatcgggctgctctgtgtcatggccagctccgctctgctttgggttgcctctgtggaaccgcattggattgctgccagcatcattctggagttctttctcatggtgctgctgatccctgaacccgaccgccagagaacgcctcaggataaccaactcgcctatgtcgtgatcggacttctgttcatgattctgaccgttgctgcgaatgagatgggcctcctggagacaaccaagaaagaccttgggatcggacacgtggccgtcgaaaaccaccatcacgctacaatgctggatgtggacctccggcccgcctccgcctggaccctgtacgctgtcgccacgaccgtgattacacctatgatgcgccataccatcgagaacacaaccgcgaatattagcctgacggccatcgctaaccaggccgctattctcatgggccttgataagggctggcccatctctaaaatggacatcggggttccgctgctggccctcggatgctactcccaggtgaatcctctgacacttaccgcggccgtcctgatgctcgtggctcactatgccattatcggccccgggctgcaagctaaggccacaagagaagctcagaagcggaccgccgcgggaattatgaaaaaccccaccgttgatggcatcgtgacaattgacctggaccctgtcgtgtacgatgccaagtttgagaaacagctcgggcagatcatgcttctgatcctgtgtacgagccaaattctcctgatgcgcaccacatgggctctttgcgaatctatcaccctggccacaggaccgctcaccacgctgtgggagggctcccccggcaagttctggaatacaaccattgctgtgagcatggccaacatcttcagagggtcttatctggccggagcgggcctcgcttttagcgttatgaaatcccttgggggaggccggcgcgggaccggagcccagggcgagacactgggcgaaaagtggaagagacagctgaatcagctctctaaaagcgagttcaacacctacaagaaatccgggattatggaagtcgaccggagcgaggctaaggaaggactgaaaagaggcgagacaacgaagcatgccgtgtcccgcgggaccgccaagcttcggtggtttgtggagagaaatctggtcaaacctgaaggaaaggttatcgatctcggctgtgggcgcggaggctggtcttattactgcgctggcctgaaaaaggtgacagaggtgaaagggtataccaagggaggccccgggcacgaagagcctatccccatggccacatacggatggaacctggtcaaactccacagcggcaaggacgtgttctttacccctccggaaaagtgtgatacgcttctgtgcgacattggggagtcctctcccaatcctaccatcgaggaaggacggacactgagagttctcaaaatggtggagccctggctgcgcggcaaccaattctgtattaagatccttaatccttacatgcccagcgtcgtggaaaccctggagcagatgcagcggaaacatggcgggatgctcgttagaaacccgctgtcccgcaattctacacacgagatgtattgggtgagctgcggaaccggcaacattgtctccgcggtgaatatgacaagccggatgctgctcaacagatttaccatggcccatcgcaagcctacgtacgaacgggatgtggacctgggggctggaacaagacacgtcgccgttgagcccgaagtggctaaccttgatatcattggccagcgcatcgagaatatcaaaaacgaacacaagtctacctggcattatgacgaggataatccctacaagacctgggcctatcacgggtcctacgaggtgaaacctagcggatctgcgtccagcatggtcaacggcgtggttagactgctcacaaagccctgggacgtgattcctatggtcacgcaaatcgccatgaccgacacaaccccgttcggccagcagcgggtgtttaaagaaaaggttgatacacgcacccccagagctaaacgggggacagcccaaattatggaggtgaccgctaagtggctgtggggattcctttctagaaataagaaacctcggatctgtacgcgcgaagagtttaccagaaaggtccggtccaacgccgctattggcgccgtgttcgttgacgaaaatcagtggaacagcgcgaaagaggccgtggaggatgaacgcttttgggacctggtccatagagagcgggaactccacaagcaggggaaatgcgctacatgcgtgtataatatgatgggaaagcgcgagaagaaactgggcgaattcgggaaggccaaaggctccagagctatctggtacatgtggctgggagcccggttcctcgagtttgaggccctgggcttcatgaacgaagatcattggtttagccgcgagaattctcttagcggggtcgaaggagagggcctgcacaagctcgggtacatcctgagagacatttccaaaatccccggaggcaacatgtatgcggatgacaccgctgggtgggatacacggattaccgaggacgatcttcagaatgaagccaagatcacggacattatggagcctgaacacgccctgctcgctacatctatcttcaaactgacctaccaaaacaaggtggttcgcgtgcagagacccgccaagagcggcacagtcatggatgtgatctcccggcgcgaccagagaggatctggccaggtggggacctatggactgaatacgtttaccaacatggaggttcaactcattcggcagatggaaagcgagggcatcttctccccgtctgagctggaaacacctaaccttgctaaaaaggtgctggactggctcgagaaacatggggccgaaagactgaagcgcatggcgattagcggagatgactgtgtcgtgaaacccatcgatgaccggtttgccaccgctcttacagccctgaatgatatgggcaaggttagaaaggacattcctcagtgggagccctccaaagggtggaacgattggcagcaagtgcctttctgcagccaccattttcaccagctcatcatgaaggacggccgcgaaatcgtcgtgccctgtcggaatcaggatgagctggtcggaagagctcgcgtgtctcagggcgccgggtggtccctgcgggagaccgcgtgcctcggaaaaagctacgcccaaatgtggcagctgatgtatttccacagacgcgaccttcggctggctgccaacgctatttgttctgccgttccggtggattgggtccctacatccagaaccacgtggagcatccatgctcaccatcagtggatgacaaccgaagacatgctctccgtgtggaatcgcgtttggattgaggaaaacccctggatggaggacaagacccacgtgtctagctgggaagaggtcccctacctgggcaaacgggaggatcaatggtgcgggtcccttatcggactgacagccagagcgacctgggccacaaatattcaggtggctatcaaccaggtgcggagactcattggcaatgaaaactatctggactacatgacgagcatgaagcgctttaagaatgagtctgatcctgaaggggccctgtggtga

SEQ ID NO: 18478 - RNA, 9879 nt, synthetic construct
  misc_feature 1..9879: note = derived and/or modified CDS sequence (opt5) from DENV-1__KF971870__SS-prME
  source 1..9879: mol_type = other RNA
agcgtgaccatgctgctcatgctgatgcccaccgcccttgctttccacctgacgaccagaggaggggagcctcatatgatggtgtccaagcaggaacggggaaaatctctcctgtttaagaccagcgccggcgttaacatgtgcacccttatcgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagatccagcgggttgaaacatgggctctgcgccaccccggcttcaccgtgatcgccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgattctgggagataccgcctgggacttcggctctatcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaagatcattggcgctgacgtgcagaataccacctttatcatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagctctgccatcaaagattccaaggctgtgcacgccgacatgggctactggattgaaagcgagaaaaatgatacctggaagctcgccagagcttctttcatcgaagtgaagacatgtatctggcccaaatcccataccctgtggagcaacggggtcctggagtctgaaatgattatcccgaagatttatggaggccctatcagccaacacaattaccgccccgggtacttcacacagaccgccggaccttggcatctcggcaaactggagcttgactttgatctgtgcgaggggacgaccgtggttgtggacgaacactgcggaaaccggggcccctccctcagaacaaccacagtcaccggcaagattatccacgagtggtgttgccggagctgtacgctgcctcccctgcgcttcagaggggaagacggatgctggtatggcatggagatccggccggtgaaagagaaggaagagaatcttgttaagtctatggtgtccgcggggagcggagaagtcgattccttttctctcggcctgctgtgtattagcatcatgattgaggaagtgatgagatcccgctggtctcggaaaatgctcatgatcgggacactggctgttttctttcttctgattatgggacagctcacctggaacgacctgatcagactgtgcattatggtgggcgccaatgccagcgatcgcatgggcatggggacaacctaccttgctctgatggccaccttcaagatgagacctatgtttgcggtcggactcctgttccggcgcctcacatccagagaggtgctgcttctgacgatcggcctctctctggtggctagcgccgagctgcccaactcccttgaagaactgggggacggactcgccatgggcatcatgattctgaaactcctgaccgattttcaaagccatcagctttgggctacactgctctctctgaccttcatcaagacaaccttttccctgcactatgcctggaaaacgatggctatggtccttagcattgtttctctgttccccctctgtctgtccacaaccagccagaagaccacatggctccctgtgctgcttgggtctctgggatgcaagccgctgaccatgtttctcatcgccgaaaataaaatttggggccggaagtcctggcccctgaacgagggcatcatggcggtggggatcgtcagcattcttctgtccagcctcctgaaaaacgacgtgcctctcgccggacccctgatcgctggcgggatgcttattgcctgttacgttatctctggaagctccgctgatctgtctctggaaaaggccgccgaggtgagctgggaggaagaggctgaacattccggcgcgtctcacaatattctcgtcgaggtgcaggacgatgggacaatgaaaatcaaggacgaagaacgcgatgacacgctgaccatccttctgaaagccacactcctggctgttagcggagtgttccctctctccattcccgccaccctgttcgtctggtatttttggcaaaagaagaaacagagatctggcgtgctttgggatacacctagccctcccgaggtcgaacgggccgtgctggacgacggcatctaccgcattatgcagagagggctgctcggacggtcccaggttggcgtgggggtcttccaagagaacgtgtttcataccatgtggcacgttacgcgcggagctgtgctgatgtatcagggcaagagacttgaacccagctgggcctctgtcaaaaaggatctgatctcctacgggggaggctggcggctccagggcagctggaataccggggaggaggtccaggtgattgcggttgaacccggcaaaaatcctaagaatgtccaaacagctcccggcaccttcaagacaccggagggggaagtgggagccatcgccctggactttaaacctggcacctctgggtcccccattgtgaacagagagggaaagatcgtcggcctctacggcaatggggtggttacaacgagcggaacctatgtgtccgctatcgcccaggcgaaggcttctcaggaaggccctctgcccgagattgaggatgaagtcttccgcaagcggaaccttacaatcatggacctgcaccccgggagcggaaaaaccagacgctacctgcctgccattgtgcgggaggccatcaagagaaagctccgcaccctgattcttgctccgacacgggttgtggcctccgaaatggctgaggccctgaaaggcatgcccatcagatatcaaacgaccgcggtcaagagcgaacatacagggaaagagatcgtggatctcatgtgccacgccacctttacaatgcgcctgctgtctcctgttcgggtgcccaattacaacatgattatcatggacgaggctcatttcaccgatccttccagcattgccgctagaggctatatctctacgcgggtcggaatgggcgaagccgccgctatttttatgacagcgacaccccctgggagcgtggaggccttcccgcagtccaatgctgtgatccaggacgaggaacgcgatatccccgaaagatcttggaacagcggatacgagtggattaccgactttcctggcaagacagtctggttcgttccctccatcaaatctgggaatgatattgccaactgtctccggaagaatggaaagcgcgtgatccagcttagcagaaaaaccttcgacacagagtatcaaaagaccaaaaacaacgactgggattacgtggtcacgacagacatttccgaaatgggcgccaattttcgggctgatagagtgatcgaccctcgccggtgcctgaagcccgttattctgaaagatgggccggagagagtgatcctcgccggccctatgcccgtcaccgtggcgagcgctgcccagcgccggggaagaatcggccgcaaccacaataaggaaggggaccagtacatttatatgggacagcccctgaacaatgatgaggaccatgcccactggacagaggctaagatgcttctggataacatcaatacccctgaaggcattatccccgccctcttcgagcctgaacgggagaaatctgcggccattgacggggaatacagactgcgcggagaggctagaaagacgtttgttgagctgatgcggcgcggcgatctcccggtgtggctttcctataaagtcgccagcgaagggttccaatactccgacagacggtggtgctttgatggcgagcgcaacaatcaggtgctggaagagaacatggacgtcgaaatctggaccaaggagggagagagagaaaaactgcggcccagatggctcggcgctcgcacatattctgaccctctggcccttcgggatttcaaggagtttgctgccgggagacgcagcgtgtccggagacctgatcctcgaaattggcaaactgccccagcacctgacccagcgggcgcaaaatgccctcgataaccttgttatgctgcataattctcagcaagggggacgggcttacacacacgccatggaggaactgcctgacaccatcgagacactcatgctgcttgctctgattgccgtgctcaccggcggcgtgacgctgttctttctgagcgggcggggactcggcaagacatccatcgggcttctgtgtgtcatggccagctctgttctgctctggatggcttccgtggagccccattggattgcggccagcatcatcctggagttctttcttatggtgctgctcattccggagcctgatcgccagagaacaccccaggacaaccagctggcttatgtcgtgatcggactcctgttcatgattcttaccgttgccgccaatgaaatgggcctgctggagacaaccaagaaagatctcgggatcggacacgtggctgtcgagaaccaccatcacgccgcgatgctggacgtggatcttcatcctgcctctgcttggacactgtacgccgtcgctacgaccattatcacacccatgatgcggcacaccattgaaaacacaaccgccaatatctccctcacggcgatcgccaaccaggctgccattctgatgggcctggacaagggctggcctatcagcaaaatggatattggggtgcccctccttgctctgggatgctactctcaagttaatccgctgaccctcacagccgctgtgctgatgcttgtcgcccattatgcgatcattggccctgggctgcaggccaaggctacccgcgaggcccagaaaagaacagctgccggaatcatgaagaaccccaccgtggacggcatcgttgccattgatctcgaccccgtggtctacgacgcgaagtttgaaaaacagctggggcaaatcatgctgctcattctttgtacgagccagatcctgctgatgcggacaacctgggctctctgcgagtccattacactggccaccggacctcttaccacactgtgggaaggctctccgggcaagttctggaatacgaccatcgctgtgagcatggccaacatcttccgcgggtcctatctcgccggagctggcctggcctttagcctgatgaaatccctcgggggaggcagacgggggacaggagcgcagggcgagacccttggcgagaagtggaaacgcagactgaatcagctgtctaagagcgagttcaacacatacaagcggtccgggattatggaggtggatagatctgaagccaaagagggactcaagcgcggcgaaaccacgaaacacgctgttagccgggggacagccaagctgagatggtttgtcgagcgcaatcttgtgaaacccgagggaaaggtgatcgacctgggctgtgggcggggaggctggtcctattactgcgctggcctcaagaaagtcaccgaagttaaggggtataccaaaggaggccctgggcacgaggaacccattcctatggccacatacggatggaacctggtgaagctgcattctggcaaagatgtgttctttattccccctgagaagtgtgacaccctcctttgcgatattggggaaagctccccgaatcccacaatcgaggagggaagaacgctgcgcgtcctgaaaatggtggaaccttggctccggggcaaccaattctgtattaagatcctgaatccctacatgcctagcgttgtggagacccttgaacagatgcagagaaagcacggcgggatgctggtccgcaaccccctctctagaaattccacacatgagatgtattgggtgagctgcggaaccggcaacatcgtttctgcggtgaatatgacatccagaatgctgctgaaccgctttaccatggcccaccggaaaccgacgtacgagagagacgtcgatctcggggctggaacccgccacgtggccgtggaacctgaggtcgctaacctggacattatcggccagagaattgaaaatatcaagcatgagcacaaaagcacatggcattatgatgaagacaacccctacaagacctgggcctatcacgggtcttacgaggttaaaccctccggaagcgcttccagcatggtgaatggcgtggtcaaacttctgacaaagccttgggatgtgattcccatggttacccaaatcgccatgacagacaccacgcctttcggccagcagcgggtgtttaaagagaaggtcgacacacgcaccccgaaagcgaagagagggaccgcccaaatcatggaagtgacagctcggtggctctggggattcctgtctagaaacaaaaagccccggatttgtacgcgcgaggaatttaccagaaaggttcggagcaatgccgctatcggcgccgtgttcattgatgagaaccagtggaactccgccaaagaagcggtcgaggacgagcgcttttgggatcttgtgcatagagaacgggagctgcacaagcaggggaaatgcgctacatgcgtttataacatgatgggaaagcgcgagaaaaagctcggcgagttcgggaaggccaaaggctctagagccatctggtacatgtggctgggagctcggttcctggaatttgaggccctcggcttcatgaatgaggaccactggtttagccgcgaaaactccctgtctggggtggagggagaaggccttcataagctggggtacattctcagagatatcagcaaaatccctggaggcaatatgtatgctgacgataccgccgggtgggacacacggattaccgaggatgacctgcagaacgaggcgaagatcacagatattatggaacccgagcacgcccttctggctaaagccatcttcaagctcacctaccaaaataaagtcgtgcgcgtccagagacctgctaagaacggcacggtgatggacgttatttcccggcgcgatcagagaggatctggccaggtggggacctatggactgaatacatttaccaacatggaagcccaactgatccggcagatggagagcgaaggcatcttctcccccagcgagctcgagacaccgaacctggcggaaagagtccttgactggctggggaagtacggagtggagcgcctcaaacggatggccatttctggcgacgattgtgtggttaagcctatcgacgatagatttgctaccgccctgacggctcttaatgacatggggaaagtgcgcaaggatattccccagtgggaaccttccaaaggctggaacgactggcagcaagtccccttctgcagccatcactttcaccagctgatcatgaaggatggacgggagattgtggttccttgtagaaatcaggacgaactcgtgggccgcgcccgggtctctcagggggctggatggtccctgagagagacagcctgcctgggcaagagctatgcgcaaatgtggcagctcatgtacttccatcgccgggatctgagacttgccgctaacgccatctgttccgccgtgcccgtcgactgggtgccgacctctcgcacaacctggagcattcacgctcatcaccagtggatgacgaccgaggatatgctgtccgtttggaatcgggtgtggatcgaagagaacccttggatggaagacaaaacacatatcagcaattgggaggacgtcccctatctcgggaagagagaagatcaatggtgcggatctctgattggccttaccgcccgggcgacatgggctaccaacatccaggtggccattaatcaggttagacgcctgatcgggaacgagaattacctcgactacatgacatccatgaaacggtttaagaacgagagcgatcccgaaggcgccctgtggtga

SEQ ID NO: 18479 - RNA, 9879 nt, synthetic construct
  misc_feature 1..9879: note = derived and/or modified CDS sequence (opt5) from DENV-1__KF971871__SS-prME
  source 1..9879: mol_type = other RNA
agcgtgaccatgctgctcatgctgatgcccacagctcttgctttccacctgacgaccagaggaggggagcctcatatgatggtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagatccagcgggttgaaacatgggctctgcgccaccccggcttcaccgtgattgccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatcacatgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgattctgggagataccgcctgggacttcggctctatcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaagatcattggcgctgacgtgcagaataccacctttatcatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagcgccgctatcaaagattctaaggccgtgcacgccgacatgggctactggattgaatccgagaaaaatgatacctggaagctcgctagagccagcttcatcgaagtgaagacatgtatctggcccaaatctcataccctgtggtccaacggggtcctggagagcgaaatgattatcccgaagatttatggaggccctatctctcaacacaattaccgccccgggtacttcacacagaccgcgggaccttggcatctcggcaaactggagcttgactttgatctgtgcgaggggacgaccgtggttgtggacgaacactgcggaaaccggggccccagcctcagaacaaccacagtcaccggcaagattatccacgagtggtgttgccggtcctgtacgctgcctcccctgcgcttcagaggggaagacggatgctggtatggcatggagatccggccggtgaaagagaaggaagagaatcttgttaagagcatggtgtctgctgggtccggagaagtcgatagcttttccctcggcctgctgtgtatttctatcatgattgaggaagtgatgagaagccgctggtcccggaaaatgctcatgatcgggacactggccgttttctttcttctgattatgggacagctcacctggaacgacctgatcagactgtgcattatggtgggcgccaatgcttctgatcgcatgggcatggggacaacctaccttgccctgatggcgaccttcaagatgagacctatgtttgctgtcggactcctgttccggcgcctcacaagcagagaggtgctgcttctgacgatcggcctctccctggtggcctctgccgagctgcccaacagccttgaagaactgggggacggactcgctatgggcatcatgattctgaaactcctgaccgattttcaatcccatcagctttgggccacactgctcagcctgaccttcatcaagacaaccttttctctgcactatgcttggaaaacgatggccatggtcctttccattgttagcctgttccccctctgtctgtctacaacctcccagaagaccacatggctccctgtgctgcttgggagcctgggatgcaagccgctgaccatgtttctcatcgcggaaaataaaatttggggccggaagtcttggcccctgaacgagggcatcatggccgtggggatcgtctccattcttctgagctccctcctgaaaaacgacgtgcctctcgctggacccctgatcgccggcgggatgcttattgcttgttacgttatcagcggatctagcgccgatctgtccctggaaaaggccgctgaggtgtcttgggaggaagaggcggaacatagcggcgcctcccacaatattctcgtcgaggtgcaggacgatgggacaatgaaaatcaaggacgaagaaagagatgacacgctgaccatccttctgaaagctacactcctggccgtttctggagtgttccctctcagcattcccgccaccctgttcgtctggtatttttggcaaaagaagaaacagagatccggcgtgctttgggatacaccttctcccccggaggtcgaacgggctgtgctggacgacggcatctaccgcattatgcagagagggctgctcggacggagccaggttggcgtgggggtcttccaagagaacgtgtttcataccatgtggcacgttacgcgcggagccgtgctgatgtatcagggcaagagacttgaaccttcctgggcgagcgtcaaaaaggatctgatctcttacgggggaggctggcggctccagggctcctggaataccggggaggaggtccaggtgattgctgttgaacccggcaagaaccctaagaatgtccaaacagcccccggcaccttcaagacaccggagggggaagtgggagccatcgctctggactttaaacctggcaccagcgggtctcccattgtgaacagagagggaaagatcgtcggcctctacggcaatggggtggttacaacgtccggaacctatgtgagcgccatcgcgcaggctaaagcctcccaggaaggccctctgcccgagattgaggatgaagtcttccgcaagcggaaccttacaatcatggacctgcaccccgggtctggaaaaaccagacgctacctgcctgccattgtgcgggaggctatcaagagaaagctccgcaccctgattcttgccccgacacgggttgtggctagcgaaatggccgaggcgctgaaaggcatgcccatcagatatcaaacgaccgccgtcaagtccgaacatacagggaaagagatcgtggatctcatgtgccacgctacctttacaatgcgcctgctgagccctgttcgggtgcccaattacaacatgattatcatggacgaggcccatttcaccgatccttcttccattgctgccagaggctatatcagcacgcgggtcggaatgggcgaagccgctgcgatttttatgacagccacaccccctgggtctgtggaggctttcccgcagagcaatgccgtgatccaggacgaggaacgcgatatccccgaaagatcctggaactctggatacgagtggattaccgactttcctggcaagacagtctggttcgttcccagcatcaaatccgggaatgatattgccaactgtctccggaagaatggaaagcgcgtgatccagctttctagaaaaaccttcgacacagagtatcaaaagaccaaaaacaacgactgggattacgtggtcacgacagacattagcgaaatgggcgctaattttcgggccgatagagtgatcgaccctcgccggtgcctgaagcccgttattctgaaagatgggccggagagagtgatcctcgcgggccctatgcccgtcaccgtggcttccgccgcccagcgccggggaagaatcggccgcaaccacaataaggaaggggaccagtacatttatatgggacagcccctgaacaatgatgaggaccatgctcactggacagaggccaagatgcttctggataacatcaatacccctgaaggcattatccccgccctgttcgagcctgaacgggagaaaagcgccgctattgacggggaatacagactgcgcggagaggccagaaagacgtttgttgagctgatgcggcgcggcgatctcccggtgtggctttcttataaagtcgcttccgaagggttccaatacagcgacagacggtggtgctttgatggcgagcgcaacaatcaggtgctggaagagaacatggacgtcgaaatctggaccaaggagggagagcgcaagaagctgcggcccagatggctcggcgcccgcacatattccgaccctctggcccttcgggagttcaaagagtttgccgcggggagacgctctgtgagcggagatctgatcctcgaaattggcaagctgccccagcacctgacccagcgggcccaaaatgctctcgacaaccttgttatgctgcataattccgagcaagggggcagagcgtaccggcacgctatggaggaactgcctgatacaatcgagaccctcatgctgcttgccctgattgccgtgctcacaggaggcgtgaccctgttctttctgtctgggcgcggactcggcaagacgagcatcgggcttctgtgtgtcatggcttccagcgttctgctctggatggcgtctgtggaaccccattggattgccgcttccatcatcctggagttctttcttatggtgctgctcattccggaacctgacagacagcggacaccccaggataaccaactggcctatgtcgtgatcggactcctcttcatgattcttaccgttgccgctaatgagatgggcctgctggagaccaccaaaaaggacctcgggatcggacacgtggccgtcgaaaaccaccatcacgcggccatgctggatgtggaccttcatcctgctagcgcctggaccctgtacgctgtcgccacaacgattatcacccccatgatgcgccacacaattgagaacaccacagcgaatatctctctcaccgccatcgctaaccaggccgctattctgatgggcctggataaaggctggcctatctccaagatggacattggggtgcccctccttgccctgggatgctacagccaggttaatccgctgacgctcaccgctgccgtgctgatgcttgtcgcgcattatgccatcattggccctgggctgcaagctaaagccacaagagaagctcagaagcggaccgccgccggaatcatgaagaaccccacagtggatggcatcgttgcgattgacctcgatcccgtggtctacgacgctaaatttgagaagcagctggggcagatcatgctgctcattctttgtacctctcaaatcctgctgatgcgcacgacatgggccctctgcgaaagcattaccctggctacaggacctcttaccaccctgtgggagggctccccgggcaaattctggaatacaacgatcgccgtgtctatggccaacatcttcagagggagctatctcgctggagccggcctggcgttttccctgatgaaaagcctcgggggaggccggcgcgggaccggagcccagggcgagacacttggcgaaaaatggaagagacggctgaatcagctgtccaagtctgagttcaacacctacaaaagaagcgggattatggaagtggaccgctccgaggctaaggaaggactcaaacggggcgagacaaccaagcacgccgtttctagagggacggctaaactgcgctggtttgtcgagcggaatcttgtgaagcccgaaggaaaggtgatcgatctgggctgtgggagaggaggctggagctattactgcgccggcctcaaaaaggtcacagaggttaaagggtataccaagggaggccctgggcacgaggagcccattcctatggcgacctacggatggaacctggtgaaactgcattccggcaaggacgtgttctttattccccctgaaaaatgtgatacactcctttgcgacattggggagtctagcccgaatcccaccatcgaggaaggacgcacactgcgggtcctgaagatggtggagccttggctcagaggcaaccagttctgtattaagatcctgaatccctacatgccttccgttgtggaaacgcttgagcaaatgcagcgcaaacacggcgggatgctggtccggaaccccctcagcagaaattctacccatgagatgtattgggtgtcctgcggaacaggcaacatcgttagcgccgtgaatatgacctctcgcatgctgctgaaccggtttacaatggctcacagaaagccgacctacgaacgcgatgtcgacctcggggccggaacgagacacgtggctgtggagcctgaagtcgccaacctggatattatcggccagcggattgagaatatcaaacatgaacacaagtccacctggcattatgacgaggataacccctacaaaacatgggcttatcacgggagctacgaggttaagccctctggatccgccagctccatggtgaatggcgtggtcaaacttctgaccaaaccttgggacgtgattcccatggttacacagatcgcgatgaccgatacaacccctttcggccaacagcgcgtgtttaaggaaaaagtcgacacgagaacaccgaaggccaaacgggggaccgctcagatcatggaggtgaccgccagatggctctggggattcctgagccggaacaagaagccccgcatttgtacaagagaagagtttacgcggaaagttcgctctaatgctgccatcggcgccgtgttcattgacgaaaaccaatggaatagcgcgaaggaggctgtcgaggatgaaagattttgggaccttgtgcatcgggagcgcgaactgcacaaacaggggaagtgcgctacctgcgtttataacatgatgggaaaaagagagaagaagctcggcgagttcgggaaagccaagggctcccgggctatctggtacatgtggctgggagcccgcttcctggagtttgaggctctcggcttcatgaatgaagatcactggttttctagagagaacagcctgtccggggtggaaggagagggccttcataaactggggtacattctccgggacatctctaagatccctggaggcaatatgtatgccgatgacacagcggggtgggatacccgcattacagaggacgatctgcagaacgaagccaaaatcaccgacattatggagcccgaacacgcccttctggccaaggctatcttcaaactcacataccagaataaggtcgtgagagtccaacggcctgccaagaacggcaccgtgatggatgttattagccgcagagaccagcggggatccggccaggtggggacgtatggactgaatacctttacaaacatggaggcgcagctgatcagacaaatggaatctgagggcatcttcagcccctccgagctcgaaaccccgaacctggccgagcgcgtccttgattggctggggaaatacggagtggaacggctcaagagaatggctattagcggcgacgactgtgtggttaaacctatcgatgaccgctttgccacagctctgaccgcccttaatgatatggggaaggtgcggaaagacattccccagtgggagccttctaagggctggaacgattggcagcaggtccccttctgctcccatcactttcaccaactgatcatgaaggacggaagagaaattgtggttccttgtcgcaatcaggatgagctcgtgggccgggctagagtcagccagggggccggatggtctctgcgcgagacggcgtgcctgggcaaatcctatgcccagatgtggcaactcatgtacttccatcggagagacctgcgccttgctgccaacgccatctgtagcgctgtgcccgtcgattgggtgccgacatcccggaccacatggtctattcacgcccatcaccagtggatgaccacggaagacatgctgagcgtttggaatagagtgtggatcgaggaaaacccttggatggaggataagacccatatctccaattgggaagacgtcccctatctcgggaaacgggaggaccagtggtgcggaagcctgattggccttacagcgagagctacctgggccacaaacatccaagtggccattaatcaggttcgccggctgatcgggaacgagaattacctcgattacatgacctctatgaagagatttaaaaacgaatccgaccccgagggcgctctgtggtga

SEQ ID NO: 18480 - RNA, 9879 nt, synthetic construct
  misc_feature 1..9879: note = derived and/or modified CDS sequence (opt5) from DENV-1__KF971869__SS-prME
  source 1..9879: mol_type = other RNA
agcgtgaccatgctgctcatgctgatgcccacagctcttgctttccacctgacgaccagaggaggggagcctcatatgatggtgtccaagcaggaacggggaaaatctctcctgtttaagaccagcgctggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagatccagcgggttgaaacatgggctctgcgccaccccggcttcaccgtgattgccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatcacatgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgattctgggagataccgcctgggacttcggctctatcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaagatcattggcgctgacgtgcagaataccacctttatcatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagcgccgctatcaaagattctaaggccgtgcacgccgacatgggctactggattgaatccgagaaaaatgatacctggaagctcgctagagccagcttcatcgaagtgaagacatgtatctggcccaaatctcataccctgtggtccaacggggtcctggagagcgaaatgattatcccgaagatttatggaggccctatctctcaacacaattaccgccccgggtacttcacacagaccgcgggaccttggcatctcggcaaactggagcttgactttgatctgtgcgaggggacgaccgtggttgtggacgaacactgcggaaaccggggccccagcctcagaacaaccacagtcaccggcaagattatccacgagtggtgttgccggtcctgtacgctgcctcccctgcgcttcagaggggaagacggatgctggtatggcatggagatccggccggtgaaagagaaggaagagaatcttgttaagagcatggtgtctgctgggtccggagaagtcgatagcttttccctcggcctgctgtgtatttctatcatgattgaggaagtgatgagaagccgctggtcccggaaaatgctcatgatcgggacactggccgttttctttcttctgattatgggacagctcacctggaacgacctgatcagactgtgcattatggtgggcgccaatgcttctgatcgcatgggcatggggacaacctaccttgccctgatggcgaccttcaagatgagacctatgtttgctgtcggactcctgttccggcgcctcacaagcagagaggtgctgcttctgacgatcggcctctccctggtggcctctgccgagctgcccaacagccttgaagaactgggggacggactcgctatgggcatcatgattctgaaactcctgaccgattttcaatcccatcagctttgggccacactgctcagcctgaccttcatcaagacaaccttttctctgcactatgcttggaaaacgatggccatggtcctttccattgttagcctgttccccctctgtctgtctacaacctcccagaagaccacatggctccctgtgctgcttgggagcctgggatgcaagccgctgaccatgtttctcatcgcggaaaataaaatttggggccggaagtcttggcccctgaacgagggcatcatggccgtggggatcgtctccattcttctgagctccctcctgaaaaacgacgtgcctctcgctggacccctgatcgccggcgggatgcttattgcttgttacgttatcagcggatctagcgccgatctgtccctggaaaaggccgctgaggtgtcttgggaggaagaggcggaacatagcggcgcctcccacaatattctcgtcgaggtgcaggacgatgggacaatgaaaatcaaggacgaagaaagagatgacacgctgaccatccttctgaaagctacactcctggccgtttctggagtgttccctctcagcattcccgccaccctgttcgtctggtatttttggcaaaagaagaaacagagatccggcgtgctttgggatacaccttctcccccggaggtcgaacgggctgtgctggacgacggcatctaccgcattatgcagagagggctgctcggacggagccaggttggcgtgggggtcttccaagagaacgtgtttcataccatgtggcacgttacgcgcggagccgtgctgatgtatcagggcaagagacttgaaccttcctgggcgagcgtcaaaaaggatctgatctcttacgggggaggctggcggctccagggctcctggaataccggggaggaggtccaggtgattgctgttgaacccggcaagaaccctaagaatgtccaaacagcccccggcaccttcaagacaccggagggggaagtgggagccatcgctctggactttaaacctggcaccagcgggtctcccattgtgaacagagagggaaagatcgtcggcctctacggcaatggggtggttacaacgtccggaacctatgtgagcgccatcgcgcaggctaaagcctcccaggaaggccctctgcccgagattgaggatgaagtcttccgcaagcggaaccttacaatcatggacctgcaccccgggtctggaaaaaccagacgctacctgcctgccattgtgcgggaggctatcaagagaaagctccgcaccctgattcttgccccgacacgggttgtggctagcgaaatggccgaggcgctgaaaggcatgcccatcagatatcaaacgaccgccgtcaagtccgaacatacagggaaagagatcgtggatctcatgtgccacgctacctttacaatgcgcctgctgagccctgttcgggtgcccaattacaacatgattatcatggacgaggcccatttcaccgatccttcttccattgctgccagaggctatatcagcacgcgggtcggaatgggcgaagccgctgcgatttttatgacagccacaccccctgggtctgtggaggctttcccgcagagcaatgccgtgatccaggacgaggaacgcgatatccccgaaagatcctggaactctggatacgagtggattaccgactttcctggcaagacagtctggttcgttcccagcatcaaatccgggaatgatattgccaactgtctccggaagaatggaaagcgcgtgatccagctttctagaaaaaccttcgacacagagtatcaaaagaccaaaaacaacgactgggattacgtggtcacgacagacattagcgaaatgggcgctaattttcgggccgatagagtgatcgaccctcgccggtgcctgaagcccgttattctgaaagatgggccggagagagtgatcctcgcgggccctatgcccgtcaccgtggcttccgccgcccagcgccggggaagaatcggccgcaaccacaataaggaaggggaccagtacatttatatgggacagcccctgaacaatgatgaggaccatgctcactggacagaggccaagatgcttctggataacatcaatacccctgaaggcattatccccgccctgttcgagcctgaacgggagaaaagcgccgctattgacggggaatacagactgcgcggagaggccagaaagacgtttgttgagctgatgcggcgcggcgatctcccggtgtggctttcttataaagtcgcttccgaagggttccaatacagcgacagacggtggtgctttgatggcgagcgcaacaatcaggtgctggaagagaacatggacgtcgaaatctggaccaaggagggagagcgcaagaagctgcggcccagatggctcgacgcccgcacatattccgatcctctggcccttcgggagttcaaagagtttgccgcgggcagacgctctgtgagcggggacctgatcctcgaaattggaaagctgccccagcacctgacccagcgggcccaaaatgctctcgataaccttgttatgctgcataattccgagcagggcgggagagcctaccggcacgctatggaggaactgcctgacacaatcgagaccctcatgctgcttgccctgattgccgtgctcacaggaggcgtgaccctgttctttctgtctggccgcgggctcggaaagacgagcatcggccttctgtgtgtcatggcttccagcgttctgctctggatggcgtctgtggaaccccattggattgccgcttccatcatcctggagttctttcttatggtgctgctcattccggaacctgatagacagcggacaccccaggacaaccaactggcctatgtcgtgatcgggctcctcttcatgattcttaccgttgccgctaatgagatgggactgctggagaccaccaagaaggatctcggcatcgggcacgtggccgtcgaaaaccaccatcacgcggccatgctggacgtggatcttcatcctgctagcgcctggaccctgtacgctgtcgccacaacgattatcacccccatgatgcgccacacaattgagaacaccacagcgaatatctctctcaccgccatcgctaaccaggccgctattctgatgggactggacaaaggctggcctatctccaagatggatattggcgtgcccctccttgccctggggtgctacagccaggttaatccgctgacgctcaccgctgccgtgctgatgcttgtcgcgcattatgccatcattggacctggcctgcaagctaaagccacaagagaagctcagaagcggaccgccgccgggatcatgaagaaccccacagtggacggaatcgttgcgattgatctcgaccccgtggtctacgacgctaaatttgagaagcagctgggccagatcatgctgctcattctttgtacctctcaaatcctgctgatgcgcacgacatgggccctctgcgaaagcattaccctggctacagggcctcttaccaccctgtgggagggatccccgggcaaattctggaatacaacgatcgccgtgtctatggccaacatcttcagaggcagctatctcgctggggccggactggcgttttccctgatgaaaagcctcggcgggggacggcgcggcaccggggcccagggagagacacttggcgaaaaatggaagagacggctgaatcagctgtccaagtctgagttcaacacctacaaaagaagcggcattatggaagtggatcgctccgaggctaaggaagggctcaaacggggagagacaaccaagcacgccgtttctagaggcacggctaaactgcgctggtttgtcgagcggaatcttgtgaagcccgaagggaaggtgatcgacctgggatgtggcagagggggatggagctattactgcgccggcctcaaaaaggtcacagaggttaaaggctataccaaagggggacctggccacgaggagcccattcctatggcgacctacgggtggaacctggtgaaactgcattccggaaaggatgtgttctttattccccctgaaaaatgtgacacactcctttgcgatattggcgagtctagcccgaatcccaccatcgaggaagggcgcacactgcgggtcctgaagatggtggagccttggctcagaggaaaccagttctgtattaagatcctgaatccctacatgccttccgttgtggaaacgcttgagcaaatgcagcgcaaacacggcggcatgctggtccggaaccccctcagcagaaattctacccatgagatgtattgggtgtcctgcgggacaggaaacatcgttagcgccgtgaatatgacctctcgcatgctgctgaaccggtttacaatggctcacagaaagccgacctacgaacgcgacgtcgatctcggcgccgggacgagacacgtggctgtggagcctgaagtcgccaacctggacattatcggacagcggattgagaatatcaaacatgaacacaagtccacctggcattatgatgaggacaacccctacaaaacatgggcttatcacggcagctacgaggttaagccctctgggtccgccagctccatggtgaatggagtggtcaaacttctgaccaaaccttgggatgtgattcccatggttacacagatcgcgatgaccgacacaacccctttcggccaacagcgcgtgtttaaggaaaaagtcgacacgagaacaccgaaggccaaacggggcaccgctcagatcatggaggtgaccgccagatggctctgggggttcctgagccggaacaagaagccccgcatttgtacaagagaagagtttacgcggaaagttcgctctaatgctgccatcggagccgtgttcattgatgaaaaccaatggaatagcgcgaaggaggctgtcgaggacgaaagattttgggatcttgtgcatcgggagcgcgaactgcacaaacagggcaagtgcgcgacctgcgtttataacatgatggggaaaagagagaagaagctcggagagttcggcaaagccaaggggtcccgggctatctggtacatgtggctgggcgcccgcttcctggagtttgaggctctcggattcatgaatgaagaccactggttttctagagagaacagcctgtccggcgtggaaggggagggacttcataaactgggctacattctccgggatatctctaagatccctgggggaaatatgtatgccgacgatacagcgggctgggacacccgcattacagaggatgacctgcagaacgaagccaaaatcaccgatattatggagcccgaacacgcccttctggccaaggctatcttcaaactcacataccagaataaggtcgtgagagtccaacggcctgccaagaacgggaccgtgatggacgttattagccgcagagatcagcggggctccggacaggtgggcacgtatgggctgaatacctttacaaacatggaggcgcagctgatcagacaaatggaatctgagggaatcttcagcccctccgagctcgaaaccccgaacctggccgagcgcgtccttgactggctgggcaaatacggggtggaacggctcaagagaatggctattagcggagacgattgtgtggttaaacctatcgacgatcgctttgccacagctctgaccgcccttaatgacatgggcaaggtgcggaaagatattccccagtgggagccttctaaggggtggaacgactggcagcaggtccccttctgctcccatcactttcaccaactgatcatgaaggatggcagagaaattgtggttccttgtcgcaatcaggacgagctcgtgggacgggctagagtcagccagggcgccgggtggtctctgcgcgagacggcgtgcctgggaaaatcctatgcccagatgtggcaactcatgtacttccatcggagagatctgcgccttgctgccaacgccatctgtagcgctgtgcccgtcgactgggtgccgacatcccggaccacatggtctattcacgcccatcaccagtggatgaccacggaagatatgctgagcgtttggaatagagtgtggatcgaggaaaacccttggatggaggacaagacccatatctccaattgggaagacgtcccctatctcggcaaacgggaggatcagtggtgcgggagcctgattggacttacagcgagagctacctgggccacaaacatccaagtggccattaatcaggttcgccggctgatcggcaacgagaattacctcgactacatgacctctatgaagagatttaaaaacgaatccgatcccgagggggctctgtggtga

SEQ ID NO: 18481 - RNA, 9879 nt, synthetic construct
  misc_feature 1..9879: note = derived and/or modified CDS sequence (opt5) from DENV-1__JN903578__SS-prME
  source 1..9879: mol_type = other RNA
agcgtgaccatgctgctcatgctgcttcccacagccctggctttccacctcacgacccggggcggggagcctcatatgatcgtctccaagcaagaacggggaaaatctctgctttttaagacaagcgttggcgtgaatatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagcgggtggaaacatgggcccttcgccaccccggcttcaccgtcatcgctctgtttctcgcccatgcgattgggacatctatcacccagaagggaatcattttcatcctgcttatgctggtgacccctagcatggccatgagatgcgttggcattgggaaccgggattttgtggagggactctccggcgctacatgggtcgacgtggtgctggagcacgggagctgtgtcacgaccatggccaagaataaacccacactggatatcgaactcctgaagaccgaggttacaaaccctgctgtgcttcgcaaactgtgcattgaagccaagatctctaataccacgacagactccagatgtccgacccaaggagaggcgaccctcgtggaagaacaggatgccaacttcgtctgccggcgcacatttgtggacagaggctggggcaatgggtgtggactgttcggcaaagggagccttctgacctgcgctaagtttaagtgcgttacaaaactcgagggaaaggtggtccagtacgaaaacctgaaatattctgtgattgttacggtgcacaccggcgatcagcatcaagtcgggaatgagacaaccgaacacggaacaatcgccaccatcacgccccaggctcctacctccgagattcagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggccagcacatcccaagagacctggaatcgccaggatctgctggtgacattcaaaaccgctcacgcgaagaagcaggaagttgtggtcctcggatctcaagagggcgccatgcacaccgctctgacaggggccacggaaatccagaccagcggaacaaccacaatttttgccggccatcttaaatgcagactgaagatggacaaactcaccctgaaggggatgtcctatgtgatgtgtacgggcagcttcaaactggagaaggaagttgctgagacacagcacggaaccgtgcttgtccaggtgaagtacgagggcaccgatgccccgtgcaaaatccctttcctcattcaagacgaaaagggggtgacacagaacggacggctgatcaccgcgaatcccatcgttacagataaagagaagcctgtcaacattgaaacggagccgccctttggcgagtcttatatcgtggtgggggctggagaaaaagccctgaagctctccagattcaagaaaggcagctctattgggaagatgtttgaggccaccgctcgcggcgcccggagaatggctatcctgggagacacagcctgggatttcggcagcattgggggagtctttacctccgtgggcaaacttatccatcaggttttcgggacagcgtacggagtgctgttttctggcgtcagctggaccatgaagatcgggattggcatcctcctgacgtggctgggacttaattcccgcagcacctctctctccatgacatgtattaccgtgggcatggttacactgtacctgggggtgatggtccaggccgacagcggatgcgtgatcaactggaaaggccgggaactcaagtgtgggtctggaattttcgttaccaacgaggtgcacacatggaccgaacaatataagtttcaggctgattcccctaaaagactgagcgccgctatcggcaaggcctgggaggagggggtctgcggcattcgctccgcgacgcggcttgaaaatatcatgtggaaacagatctctaacgagctgaatcatattctcctggaaaacgacatgaagttcacagtggtggtcggagacgccaatggcatcctggctcaggggaaaaagatgattagaccgcaacccatggagcacaaatacagctggaagtcctggggaaaggccaaaatcattggcgctgatatccagaacaccacctttatcattgacgggcctgatacacccgaatgtcctgacgatcagcgcgcctggaatatctgggaggttgaggactatggattcggcatttttaccacgaacatctggcttaagctccgggattcttacacacagatgtgcgaccacagactgatgagcgccgctattaaagattccaaggcggtgcatgccgacatgggctattggatcgaaagcgagaaaaatgaaacctggaagctggctcgcgcctctttcatcgagattaagacatgtatctggcccaaatcccacaccctctggagcaacggggtgctggaatctgagatgattatcccgaagatttacggaggccctatctcccaacataatcaccggcccgggtatttcacacagaccgccggaccttggcaccttggcaaactggagctcgattttgacgtctgcgaagggacgaccgtggttgtggatgagcattgcggaaacagaggccccagcctgcggacaaccacagtcaccggcaagatcattcacgaatggtgttgccgctcttgtacgctgcctccccttagattcagaggggaagacggatgctggtacggcatggagatcagaccggtgaaagaaaaggaggaaaatctcgttcgcagcatggtgtccgctgggagcggagaggtcgactctttttccctgggcctgctctgtgtgagcattatgatcgaagaggttatgcggtccagatggtctcgcaagatgctgatgacagggacccttgccgtgttctttctgctcattatgggacagctgacatggaacgatctgatcagactttgcattatggtcggcgcgaatgtgagcgaccggatgggcatggggaccacctacctggctctcatggccacattcaaaatgcgccctatgtttgccgtgggactcctgttcagacggctgacgtcccgcgaggtccttctgctcaccatcggcctgtctctggttgctagcgccgaacttcccaactccctggaggaactcggggatggactggcgatgggcatcatgatgctcaagctgcttacagactttcaatctcatcagctgtggaccacactcctgagcctgaccttcattaaaacgacactttccctggattatgcttggaagaccatcaccatgattctcagcatcgtgtctctgtttcccctctgtctgtccacaaccagccagaaaacaacgtggcttcctgtgctgctggggtctttcggatgcaagccgctcaccatgtttctgattacagagaacaagatctggggcagaaaatcctggccccttaatgaaggcatcatggccgtcgggattgtgagcatcctgctctcttccctgctcaagaacgacgttcctctggccggaccccttattgctggcgggatgctgatcgcctgttacgtgattagcggatccagcgctgatctgtctctcgagaaagccgcggaggtcagctgggaagaggaagccgagcactccggcacctctcataatatcctggtggaagttcaggacgatgggacaatgaagatcaaagacgaggagcgggatgacacccttacgattctgctcaaggctaccctgctcgccgtgagcggagtctatcctatgtccatccccgctacactgttcgtgtggtacttctggcagaagaagaagcagcgctctggcgtcctttgggatacccctagccctcccgaagtggagagagccgttctggacgacggcatttatcggatcctgcagcgcgggctcctgggaagatcccaggtgggcgtcggggtgtttcaagatggagttttccacacaatgtggcacgtgacccggggcgccgtccttatgtaccaggggaaaagactggaaccctcttgggctagcgtgaagaaagacctcatttcctatggaggcggctggcgctttcaggggagctggaacacaggagaggaggtgcaggttatcgcggtcgaacccggcaagaatcctaaaaacgtgcaaacgacccccgggacattcaagaccccggagggagaagtgggcgccattgctctggattttaagcctgggacctctggatcccccatcgtcaatcgggagggcaaaatcgtgggcctctacgggaacggagttgtgacaacgagcggcacctacgtctctgccattgcccaggctaaggcctcccaggaagggcctctgcccgagatcgaggacgaagtgttcaaaaagagaaatcttacaattatggatctgcatcccggaagcggcaaaacccgccggtatctgcctgcgatcgttagagaggctattaagcgcaagctccggacactgatccttgccccgaccagagtggtcgcctccgaaatggctgaggccctgaaagggatgcccatccgctaccaaacgacagcggtgaagtctgaacacaccggccgggagattgttgacctcatgtgccatgctacctttacaatgagactgctgagccctgtgcgggtccccaactataatatgatcattatggatgaggcccacttcaccgaccctgcctccatcgctgcccgcggatacattagcacaagagtgggcatgggggaagctgccgcgatctttatgaccgccacgccccctggatctgtggaggctttcccgcagtccaacgccgtcatccaggatgaagagaaagacattcccgaacggagctggaactctggctatgattggatcacagactttcctgggaagaccgtttggttcgtgcccagcattaaatccggaaacgacatcgctaattgtctccgcaagaacggcaagagagtgattcagctttctcggaaaacattcgataccgagtaccaaaagacgaaaaacaatgactgggattatgtcgtgaccacagacatcagcgagatgggggccaactttagagccgatcgcgttattgaccctcggagatgcctgaagcccgtgatcctgaaagatggcccggaacgcgtcatcctcgctggacctatgcccgtgaccgttgcgtccgccgctcagcggagaggccgcattgggcggaatcagaacaaggagggagaccagtacgtgtacatgggccaacccctgaataacgatggggaccatgcccactggacagaagccaagatgcttctggataatatcaacacccctgagggaattatccccgctctcttcgagcctgaaagagagaaatctgccgcgattgacggcgaatatcgcctgagaggggaggctcggaagacatttgtcgaactgatgcgcagaggcgatctcccggtgtggcttagctacaaagtcgcctccgagggattccagtatagcgaccggcgctggtgctttgacggcgagagaaataaccaggtgctggaagagaatatggatgttgaaatctggaccaaggagggggaacggaaaaagctgagaccccgctggctcgacgcccggacgtactctgatcctctggctcttagagagttcaaagagtttgccgcgggacgccggtccgtgagcggcgacctgatcctcgaaattgggaagctgccccagcacctgacactcagagcccaaaacgctcttgataatctggtgatgctgcataactccgagcagggaggcaaggcctatcggcacgctatggaggaactccctgacaccatcgaaaccctgatgcttctggccctcattgctgtcctgacaggcggggttaccctgttctttctctctggaaaaggccttgggaagacaagcatcggactgctgtgtgtgatggcctcctctgcgctcctgtggatggccagcgtggagccccattggattgctgcctccatcatccttgagttctttctgatggtcctcctgattccggaacctgatcgccagagaacgccccaggacaatcaactggcttacgtggttatcggcctccttttcatgattctgaccgtggccgccaacgagatggggctgctcgaaacaaccaaaaaggatctgggaatcggccacgtcgctgcggagaaccaccatcacgccacaatgcttgacgtggatctgcggcctgctagcgcctggaccctctatgccgtcgctacgaccgtgattacacccatgatgcgccataccatcgagaatacaaccgccaacatttctctgacggcgatcgccaatcaggctgccatcctgatgggcctcgacaaagggtggcctatttccaagatggatatcggagttccccttctggctctgggctgctacagccaggtgaacccgctcacactgaccgccgcggtccttatgctggtggcccactacgctattatcgggcctggactccaagccaaggctacaagagaagcccagaaacggaccgctgccggcattatgaagaatcccaccgttgacgggatcgtggcgatcgacctggatcccgtcgtgtatgacgccaaatttgagaagcagctgggacagattatgctccttatcctgtgtacatctcaaattctgctcatgcgcacgacctgggctctgtgcgaatccatcacacttgccaccggccctctgacaaccctctgggagggcagcccggggaaattctggaacacgacaattgctgtgtctatggccaatatcttcagaggaagctacctggccggcgcggggctggctttttccctcatgaagtctcttggaggcagccggcgcgggaccggagcccagggcgaaaccctgggcgagaagtggaaaagacagctgaaccagctctccaagagcgagttcaatacatataaacggtccgggatcatggaagttgatagatctgaggctaaggaaggactgaaacgcggcgagaccacaaagcatgccgtcagccgggggacggccaaacttagatggtttgtggaacgcaacctggtgaaacccgagggaaaggtcattgacctcggctgtgggcggggaggctggtcctactattgcgctggcctgaaaaaggttaccgaggtgaaagggtacacaaagggaggccctgggcacgaggagcccatccctatggccacctatggatggaatctggtgaaactccactctggcaaggatgtcttctttattccccctgaaaagtgtgacacacttctgtgcgatatcggggagagctccccgaaccccaccattgaagagggaagaacgctgcgcgtgctcaaaatggttgagccttggctgcggggcaatcaattctgtatcaagattcttaacccctacatgccttctgtggtcgaaaccctggagcagatgcagagaaaacatggcgggatgctcgtgcgcaatcccctgagccggaactccacacacgaaatgtactgggttagctgcggaaccggcaatatcgtgtctgcggtcaacatgacatccagaatgctgctcaaccgctttaccatggcccatcggaagccgacatatgagagagacgtggatctgggggctggaacccgccacgtggccgtcgagcctgaagttgctaatcttgacatcattggccagagaatcgagaacattaaaaatgaacacaagagcacgtggcattacgatgaggacaacccctataagacatgggcctaccacgggtcttatgaagtgaaaccctccggaagcgcgtcttccatggtgaatggcgtcgtgcggctgctcaccaagccttgggacgttatccccatggtgacccaaattgccatgacagatacgacccctttcggccagcagcgcgtctttaaagagaaggtggacacaagaaccccgcgggctaaaagagggacagcccaaatcatggaggttaccgctaagtggctgtggggattccttagccggaacaagaaaccccgcatctgtacaagagaagagtttacccggaaggtgcgctccaatgccgctattggcgccgtcttcgtggatgaaaaccagtggaatagcgcgaaagaggccgttgaagacgagagattttgggatctggtgcatcgggagcgcgaactccacaagcaggggaaatgcgctacgtgcgtctacaacatgatgggaaagagagagaagaaactgggcgagttcgggaaggccaaaggctctcgggctatctggtatatgtggctgggagcccgcttcctcgagtttgaagccctgggcttcatgaatgaggaccattggtttagcagagagaactccctttctggggtggaaggagagggcctgcacaagctcgggtacattctgcgggatatcagcaaaattcctggaggcaatatgtacgcggacgataccgctgggtgggacacacgcatcaccgaagatgaccttcagaacgaggccaagatcacagatattatggagcccgaacacgccctgctcgctacctccatcttcaaactgacgtatcaaaataaggtcgtgagagttcagcggcctgccaagtctggcacagtgatggacgtcattagccgcagagaccagcggggatccggccaggtggggacctacggactgaacacatttaccaacatggaggtgcaactcatcagacagatggaatctgagggcattttcctgcccagcgaacttgagacgccgaatctggctaaacgcgttctcgattggctggagaagcatggggccgaacggcttaaaagaatggcgatctccggagacgattgtgtggtcaagcctatcgacgatcgctttgccaccgctctgacagccctcaacgacatgggcaaagtgcggaaggatattccccagtgggagcctagcaaggggtggaatgactggcagcaagttcccttctgctctcaccattttcaccagctgatcatgaaagatggcagagaaattgtggtcccttgtcgcaaccaggacgagctggtgggacgggctagagtctcccagggcgccgggtggagcctccgcgaaaccgcgtgcctgggaaagtcttatgcccaaatgtggcagcttatgtacttccaccggagagatctgcgcctcgctgccaatgctatctgttccgccgtgcccgttgactgggtgccgacaagccggaccacatggtccattcatgctcaccatcagtggatgaccacggaggacatgctgtctgtctggaacagagtgtggatcgaggaaaatccttggatggaggataaaacacacgttagctcctgggaagaggtgccctatcttggcaagcgggaagaccaatggtgcgggagcctgattggactcaccgccagagcgacctgggccacaaacatccaggtcgctatcaatcaggtgcgccggctgattggcaacgagaattacctggattatatgaccacaatgaaaagatttaagaacgagtctgaccccgaaggggccctctggtga

SEQ ID NO: 18482 - RNA, 9879 nt, synthetic construct
  misc_feature 1..9879: note = derived and/or modified CDS sequence (opt5) from DENV-1__JN903579__SS-prME
  source 1..9879: mol_type = other RNA
agcgtgaccatgctgctgatgctgcttcccaccgctctggctttccacctcacgacccggggaggggaacctcatatgattgtcggaaagcaggaacggggcaaatccctgctttttaagacatctgctggggttaacatgtgcaccctgattgcgatggacctcggagagctgtgtgaagatacaatgacctacaaatgcccccgcatcacagaggctgaacccgacgatgtggactgttggtgcaatgccaccgatacgtgggtgacctatggcacatgtagccaaaccggggagcacagacgggacaagcgctccgtcgccctggctcctcatgtgggactcggcctggagacaagaaccgaaacgtggatgtctagcgagggcgcctggcggcagattcagaaagttgaaacatgggcccttcgccaccccgggttcaccgtgatcgccctgtttctcgcgcatgccattggaacatccatcacccagaagggcatcattttcatcctgcttatgctggtcaccccttctatggctatgagatgcgtggggattggaaaccgggattttgttgagggcctcagcggggccacatgggtggacgtcgtgctggagcacggatcctgtgtgacgaccatggctaagaataaacccacactggatatcgaactcctgaagaccgaggtcacaaaccctgccgttcttcgcaaactgtgcattgaagcgaagatcagcaataccacgacagactctagatgtccgacccaaggcgaggccaccctcgtggaagaacaggatgctaacttcgtgtgccggcgcacatttgtcgacagaggctgggggaatggatgtggcctgttcgggaaaggatcccttctgacctgcgccaagtttaagtgcgtgacaaaactcgagggcaagattgttcagtacgaaaacctgaaatatagcgtgatcgtcacggtgcacaccggggatcagcatcaagttggaaatgagacaaccgaacacggcacaatcgctaccattacgccccaggcccctacctctgagatccagctgacagactacggcgccctcaccctggactgtagcccccggacagggcttgatttcaacgaaatggtgctgctcaccatgaaggagaaaagctggctggtccataagcagtggtttcttgacctgcctctcccctggacgtctggagcttccacaagccaagagacctggaatcgccaggatctgctggtgacattcaaaaccgcgcacgccaagaagcaggaagtcgtggttctcggctcccaagagggggctatgcacaccgccctgacaggagccacggaaattcagacctctggcacaaccacaatctttgctgggcatcttaaatgcagactgaagatggacaaactcaccctgaagggcgtgagctatgtcatgtgtacgggatccttcaaactggagaaggaagtggccgagacacagcacggcaccgttcttgtgcaggtcaagtacgaggggaccgatgcgccgtgcaaaattcctttcagcacacaagacgaaaagggagtgacccagaacggccggctcatcacagctaatcccatcgtgacggataaagagaagcctgttaacattgaaaccgagccgccctttggggagtcttatatcgtcattggagccggcgaaaaagccctgaagctgtcctggttcaagaaagggagctctatcggcaagatgtttgaggctacagccagaggagctcgccggatggccattctcggcgacaccgcgtgggatttcgggagcatcggaggcgtgtttacatccgtggggaaactggtccatcaggtgttcggaaccgcctacggcgttctcttttctggggtgagctggacgatgaagatcggcattggaatcctgctcacctggctgggcctcaattccagaagcacatctctttccatgacctgtattgctgtcgggatggtgacactctacctgggagttatggtgcaggccgacaccggctgcgtcatcaactggaaagggcgcgaactgaagtgtggaagcggcattttcgtgacaaacgaggttcacacctggacggaacaatataagtttcaggctgattctcctaaacggctctccgccgcgatcgggaaggcctgggaggagggcgtgtgcggaattagaagcgctacacgcctggaaaatatcatgtggaaacagatctccaacgagcttaatcatattctgctcgaaaacgacatgaagttcaccgtcgtggtgggcgacgccaatgggatcctgacccagggcaagaagatgattcggccgcaacccatggagcacaaatactcttggaaaagctggggcaaggctaagatcattggggccgatacacagaacaccacgtttatcatcgacggacctgatacacccgaatgtcctgacgatcagagagcctggaatatttgggaggtcgaggactatggcttcggcatctttaccacaaacatttggctgaaacttcgcgattcctacacccagatgtgcgaccaccggctcatgtctgctgcgatcaaagatagcaaggccgttcatgctgacatggggtattggattgaatccgagaaaaatgaaacatggaagctggccagagccagcttcatcgaggtgaagacctgtatctggccccgctctcacacgctgtggtccaacggagtgctcgaaagcgagatgattatcccgaaaatttacggcgggcctatctctcaacataattatcggcccggatacttcacccagacagctggcccttggcacctggggaaacttgagctggattttaacctctgcgaaggaaccacagtcgtggttgacgagcactgcggcaatagaggcccctccctgcggaccacgacagtgaccgggaaaattatccatgaatggtgttgccgcagctgtacactgcctccccttagattccggggagaggatggctgctggtacgggatggagatcagaccggtcaaggaaaaagaggaaaacctcgtgcgctctatggttagcgccggatccggcgaggtggacagcttttctctggggctgctctgtgtctccattatgatcgaagaggtgatgcggagcagatggtcccgcaagatgctgatgaccggaacccttgcggttttctttctgctcattatgggccagctgacatggaatgacctgatcagactttgcattatggtgggcgctaacgtctctgatcggatggggatgggaacgacctatctggccctcatggccacattcaagatgcgccctatgtttgctgtgggcctgcttttcagacggctgaccagccgcgaggtgcttctgctcacaatcgggctgtccctggtcgcctctgcggaacttcccaacagcctggaggaactcggagacggcctggctatggggattatgatgctcaaactgcttaccgattttcaatcccaccagctgtggacgacactcctgtctctgaccttcatcaagaccacacttagcctggactacgcctggaaaaccatcgccatgattctctccatcgttagcctgtttcccctctgtctgtctacaacgtcccagaagaccacatggcttcctgtgctgctggggtccttcggctgcaaaccgctcaccatgtttctgattacagagaataagatctggggcagaaagtcttggccccttaacgaagggattatggctgtgggaatcgtctccatcctgctcagctctctgctcaaaaatgatgtgcctctggccggcccccttattgctgggggaatgctgatcgcctgttatgttatttccggcagctccgcggacctgagcctcgagcgggccgctgaggtgtcttgggaagaggaagccgagcatagcggggcttcccacaacatcctggtcgaagtgcaggatgacggaaccatgaagattaaagatgaggagcgcgacgatacgcttaccatcctgctcaaggccacactgctcgccgtttctggcgtgtaccctatgagcatccccgctaccctgttcgtctggtatttctggcagaagaagaaacagagatccggcgtgctttgggacacaccttctcccccggaagtcgagcgggcggtgctggatgacgggatttaccgcatcctgcagagaggactcctgggccggagccaggttggggtgggagtctttcaagacggcgtgttccataccatgtggcacgttacaagaggggccgtgcttatgtatcagggaaagcgcctggaaccttcctgggcttctgtcaagaaagatctcattagctacggcggcgggtggcggtttcagggatcctggaatacgggcgaggaggtgcaagtgatcgccgttgaacccgggaagaaccctaaaaatgtccaaaccacacccggaaccttcaagaccccggagggcgaagtgggggccattgctctggactttaaacctggaacaagcggctctcccatcgtgaacagagagggcaagattgtcgggctctacggaaatggcgtggttacgacctccgggacatatgtgagcgccatcgcgcaggctaaggcctctcaggaaggacctctgcccgagatcgaggatgaagtcttcaaaaagcgcaaccttaccattatggacctgcaccccggctccgggaaaacacggagatacctgcctgccatcgtgcgcgaggctattaagcggaaactcagaaccctgatccttgccccgacgcgcgttgtggcgagcgaaatggctgaggccctgaagggcatgcccattcggtatcaaacaaccgccgtcaagtccgaacataccggaagagagatcgtggatctcatgtgccacgctacatttaccatgcggctgctgtctcctgttcgcgtgcccaattacaacatgatcattatggacgaggcccatttcacagatcctgctagcatcgccgcgagaggctatatttccacccgggtcgggatgggagaagccgctgccatctttatgacggctacaccccctggcagcgtggaggccttcccgcagtctaatgccgtgattcaggacgaagaacgcgatatccccgaaagatcctggaacagcgggtacgactggatcaccgattttcctggaaaaacagtctggttcgttccctctattaagagcggcaatgacatcgctaactgtctccggaaaaacgggaagagagtgattcagctttcccgcaaaaccatcgacacggagtatcaaaagaccaagaataacgattgggactacgtggtcacaaccgatatttctgagatgggcgcgaatttccgggccgacagagtgatcgatcctcgccggtgcctgaaacccgttattctgaaggacggaccggaaagagtgatcctcgctggccctatgcccgtcacagccgccagcgctgcccagcgccgggggagaatcggacgcaaccagaataaagagggcgatcagtacatttatatggggcaacccctgaacaatgacgaagatcacgcgcattggaccgaggctaagatgcttctggacaacatcaatacacctgagggaattatccccgccctctttgaacctgagagagaaaaatccgccgctattgatggcgagtaccggctgcgcggggaagccagaaagaccttcgtggagctgatgcggcgcggcgacctcccggtttggctttcttataaggtggcgagcgagggatttcagtactccgatagacggtggtgcttcgacggcgaaagaaacaatcaggtcctggaggaaaacatggacgtggagatctggacgaaagaaggggagcgcaagaaactgcggcccagatggctcgatgcccgcacatatagcgaccctctggcccttcgggagtttaaggagttcgccgctggaagacggtctgtctccggcgatctgatcctcgagattgggaaactgccccagcacctgaccctccgcgcccaaaatgctcttgacaacctggtgatgctgcacaatagcgaacagggaggcaaggcctacagacatgcgatggaggaactccctgataccatcgagacactgatgcttctggccctcattgctgttctgaccggcggggtgacactgtttttcctctccggaaaaggccttgggaagacgtctatcggactgctgtgtgtgatggccagctccgtcctcctgtggatggcttctgttgagccccactggattgccgccagcatcatccttgaatttttcctgatggtgctcctgattccggagcctgaccggcagcgcacaccccaggataaccaactggcttatgtggtcatcggctccctctttatgattcttacagtggcggccaacgaaatggggctgctggagaccacaaagaaagacctcggaatcggccatgttgtggctgagaatcaccaccatgccaccacgctggatattgaccttcaccctgccagcgcttggaccctgtacgccgtcgcgacaaccatcattacacccatgatgagacataccatcgaaaacacgacagccaatatctctctcaccgctattgccaaccaggctgccatcctgatgggcctggataaggggtggcctatttccaaaatggacatcggagtgcccctccttgcgctgggctgctacagccaggtcaatccgctgacactcaccgccgctgtgctgatgcttgttgcccactatgctattatcgggcctggactgcaagccaaggctacccgggaggcccagaaacgcacagcggccggcatcatgaagaaccccacggtggatgggattgtcgctatcgacctcgaccccgtggtttacgatgccaagttcgaaaaacagctgggacagattatgctgctcatcctttgtacctctcaaattctgctgatgagaacaacctgggctctctgcgagtccatcacactggccaccggccctcttacgacactgtgggaaggcagcccggggaagttttggaataccaccatcgccgtgtctatggcgaacattttccggggaagctatctcgctggcgccgggctggctttctccctgatgaaatctctcggaggcgggcgcagaggaacaggcgcccagggcgagacccttggggagaagtggaaacggcagctgaatcagctgagcaagtccgaatttaacacatacaagagaagcggaatcatggaggtcgaccgctccgaagccaaagagggcctcaagagaggggaaacgaccaaacatgctgtgtctagaggaacagccaagctgcgctggttcgtggagcggaatcttgttaaacccgagggcaaggtcattgatctggggtgtggaagaggcggctggagctattactgcgcggggctcaagaaagtgaccgaagtgaagggatatacaaaaggcgggcctggacacgaggaacccatccctatggccacctacggctggaacattgtcaagctgcactccgggaaagacgtgtttttcacgccccctgagaagtgtgataccctgctctgcgacatcggagaatctagcccgaatcccacaattgaggagggccgcacccttcgggttctgaaaatggtggaaccttggctgagaggcaaccaattttgtatcaagatcctcaatccctacatgccttccgtcgtggagacactggaacagatgcagcgcaagcatgggggaatgcttgttcggaaccccctgtctagaaatagcacccacgagatgtattgggtgtcctgcggcacagggaacattgtcagcgctgtgaacatgacctctcgcatgctcctgaatcggttcacgatggcccatagaaaaccgacatacgagcgcgatgttgacctgggagctggcaccagacacgtggccgtcgaacctgagatcgcgaacctcgatattatcgggcagcggattgaaaatatcaagaacgagcacaaatccacctggcattatgacgaagataatccctacaagacatgggcctatcacggaagctacgaggtgaaaccctctggctccgctagctctatggtgaacggcgtcgttcgcctgcttacgaagccttgggacgtgatccccatggtgacccaaattgccatgacagacaccacaccttttgggcagcagagagtcttcaaggagaaagtggatacccggacaccgagacccaagcggggaaccgctcaaatcatggaagttacggccaaatggctgtggggctttctctcccgcaataagaaacctagaatttgtacccgggaggagttcacacgcaaggtgagaagcaacgctgccatcggggcggtctttgtggacgagaatcagtggaactccgccaaggaagctgttgaggatgagcggttctgggacctggtgcatcgcgaaagagagcttcacaaacagggaaagtgcgctacctgcgtctataatatgatgggcaaacgggaaaagaaactgggggagtttggcaaggccaagggaagccgcgccatttggtacatgtggctcggcgccagattcctggagttcgaggcgctggggtttatgaacgaggatcattggttctctcgggaaaatagcctctccggagtggagggcgaagggctgtacaaacttggatatatcctgcgcgacatctctaagattcccggcgggaacatgtacgctgatgacacagccggctgggataccagaatcacggaggacgatctccagaatgaggccaaaattacagacatcatggaacctgagcacgctctgcttgccaccagcatttttaagctgacatatcaaaacaaagttgtgcgggtccagcgccccgctaagtccggaaccgtgatggatgtcatctctagacgggaccagagaggcagcggacaggtgggaacgtacggcctcaacaccttcacaaatatggaagttcaactgatccgccagatggagtccgaagggatcttttctccgagcgagctggagaactccaatctcgccgaacgggtgctggactggcttgagaaacacggagtcgaaagactgaagcgcatggcgatcagcggcgatgactgtgtggtgaagcctaccgatgaccggttcgccacagctctcaccgccctgaacgatatggggaaagttagaaaggacattccccagtgggagccttctaaaggctggaatgattggcagcaagtgcccttttgctcccatcacttccatcagcttatcatgaaggacggacgcgaaattgtcgtgccttgtcggaaccaggatgagctggttggcagagctcgcgtgagccagggggccggatggtctctccgggagacagcgtgcctgggcaaatcctatgcccaaatgtggcagctgatgtactttcacagacgcgacctccggctggctgccaatgctatctgtagcgccgtccccgtgaactgggtcccgacctccagaacgacatggtctattcacgctcatcaccagtggatgaccaccgaagatatgcttagcgtgtggaatcgggtttggatcgaggaaaacccttggatggaggacaagacacatgtgtccagctgggaagacgtcccctatctggggaagagagaggatcaatggtgcggatctctcatcggcctgaccgcccgcgcgacatgggccacgaatattcaggtggctatcaaccaggttcggagacttattgggaatgagaactactccgactacaccacaagcatgaaacgcttcaagaatgaatctgatcccgagggcgccctgtggtga

SEQ ID NO: 18483 - RNA, 9879 nt, synthetic construct
  misc_feature 1..9879: note = derived and/or modified CDS sequence (opt5) from DENV-1__JN903580__SS-prME
  source 1..9879: mol_type = other RNA
agcgtgaccatgctgctcatgctgcttcccacagctctggctttccacctcacgaccagaggcggggagcctcatatgatcgtctccaagcaggaacggggaaagtctctgctttttaagacaagcgctggcgttaatatgtgcaccctgattgcgatggacctcggggagctgtgtgaagatacaatgacctacaagtgcccccgcatcacagaggctgaacccgacgatgtggactgttggtgcaatgctaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaggaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctttctctacacaagacgaaaagggggtgacccagaacggacggctcatcacagctaatcccatcgtgacggataaagagaagcctgttaacattgaaaccgagccgccctttggcgagtcctatatcgtcattggggccggagaaaaagccctgaagctgagctggttcaagaaaggctctagcatcgggaagatgtttgaggctacagccagaggcgctcgccggatggccattctcggagacaccgcgtgggatttcggctccatcgggggagtgtttacatctgtgggcaaactggtccatcaggtgttcgggaccgcctacggagttctttttagcggcgtgtcctggacgatgaagatcgggattggcatcctgctcacctggctgggactgaatagcagaaacacatctctttccatgacctgtattgctgtcggcatggtgacactctacctgggggttatggtgcaggccgacaccggatgcgtcatcaactggaaaggccgcgaactgaagtgtgggagcggaattttcgtgacaaatgaggttcacacctggacggaacaatataagtttcaggctgattctcctaaacggctctccgccgcgatcggcaaggcctgggaggagggggtgtgcggcattagaagcgctacacgcctggaaaacatcatgtggaaacagatctccaatgagcttaaccatattctgctcgaaaatgacatgaagttcaccgtcgtggtgggagacgccaacggcatcctgacccaggggaaaaagatgattcggccgcaacccatggagcacaaatactcttggaaaagctggggaaaggctaagatcattggcgccgatacacagaataccacgtttatcatcgacgggcctgatacacccgaatgtcctgacgatcagagagcctggaacatttgggaggtcgaggactatggattcggcatctttaccacaaatatttggctgaaacttcgcgattcctacacccagatgtgcgaccaccggctcatgtctgctgcgatcaaagatagcaaggccgttcatgctgacatgggctattggattgaatccgagaaaaacgaaacatggaagctggccagagccagcttcatcgaggtgaagacctgtatctggccccgctctcacacgctgtggtccaatggggtgctcgaaagcgagatgattatcccgaaaatttacggaggccctatctctcaacataactatcggcccgggtacttcacccagacagctggaccttggcacctgggcaaacttgagctggattttaatctctgcgaagggaccacagtcgtggttgacgagcactgcggaaacagaggcccctccctgcggaccacgacagtgaccggcaaaattatccatgaatggtgttgccgcagctgtacactgcctccccttagattcagaggggaagatggatgctggtacggcatggagatccggccggtcaaggaaaaagaggaaaatctcgtgcgctctatggttagcgccgggtccggagaggtggacagcttttctctgggcctgctctgtgtctccattatgatcgaagaggtgatgaaaagccggtggtccagaaagatgctgatgaccgggacccttgcggttttctttctgctcattatgggacagctgacatggaacgacctgatccgcctttgcattatggtgggcgctaacgtctctgatagaatgggcatggggacgacctatctggccctcatggccacattcaaaatgcggcctatgtttgctgtgggactcctgttccgcagactgaccagccgggaggtgcttctgctcacaatcggcctgtccctggtcgcctctgcggaacttcccaatagcctggaggaactcggggacggactggctatgggcattatgatgctcaagctgcttaccgattttcaatcccaccagctgtggacgacactcctgtctctgaccttcatcaaaaccacacttagcctggactacgcctggaagaccatcgccatgattctctccatcgttagcctgtttcccctctgtctgtctacaacgtcccagaaaaccacatggcttcctgtgctgctggggagcttcggatgcaagccgctcaccatgtttctgattacagagaacaagatctggggccgcaaatcttggccccttaatgaaggcattatggctgtggggatcgtctccatcctgctcagctctctgctcaagaacgatgtgcctctggccggaccccttattgctggcgggatgctgatcgcctgttatgttatttccggaagctccgcggacctgagcctcgagagagccgctgaggtgtcttgggaagaggaagccgagcatagcggcgcttcccacaatatcctggtcgaagtgcaggatgacgggaccatgaaaattaaggatgaggagcgggacgatacgcttaccatcctgctcaaagccacactgctcgccatctctggagtttaccctatgagcattcccgctaccctgttcgtgtggtatttctggcaaaagaaaaagcagcgctccggcgtcctttgggacacaccttctcccccggaagtggagagagcggtcctggatgacggcatctaccggattctgcagcgcgggctcctgggaagaagccaggtgggcgttggggtgtttcaagacggagtcttccggaccatgtggcatgtgacaagaggcgccgttcttatgtatcaggggaagcgcctggaaccttcctgggcttctgtgaaaaaggatctcatcagctacggaggcggctggcggtttcaggggtcctggaacacgggagaggaggtccaggtgattgccgtggaacccggcaaaaatcctaagaacgttcaaaccacacccgggaccttcaaaaccccggagggagaagtcggcgccatcgctctggactttaagcctgggacaagcggatctcccattgtgaatagagagggcaagatcgtgggcctctacgggaacggagtcgtgacgacctccggcacatatgttagcgccatcgcgcaggctaaagcctctcaggaagggcctctgcccgagattgaggatgaagtgttcaagaaacgcaatcttaccatcatggacctgcaccccggatccggcaagacacggagatacctgcctgccattgtccgcgaggctatcaaacggaagctcagaaccctgattcttgccccgacgcgcgtggttgcgagcgaaatggctgaggccctgaaggggatgcccatccggtatcaaacaaccgccgtgaaatccgaacacaccggcagagagatcgtcgatctcatgtgccatgctacatttaccatgcggctgctgtctcctgtgcgcgttcccaactacaatatgattatcatggacgaggcccacttcacagatcctgctagcattgccgcgagaggatatatctccacccgggtgggcatgggggaagccgctgccatttttatgacggctacaccccctggaagcgtcgaggccttcccgcagtctaacgccgtgatccaggacgaagaacgcgatatccccgaaagatcctggaatagcggctacgactggattaccgattttcctgggaagacagtgtggttcgtcccctctatcaaaagcggaaacgacattgctaactgtctccggaagaatggcaaaagagttatccagctttcccgcaagaccttcgacacggagtatcaaaagaccaaaaacaatgattgggactacgtggtgacaaccgatatttctgagatgggggcgaactttcgggccgacagagtcatcgatcctcgccggtgcctgaagcccgtgattctgaaagacggcccggaaagagttatcctcgctggacctatgcccgtgacagccgccagcgctgcccagcgccggggcagaatcgggcgcaatcagaacaaggagggagatcagtacatttatatgggccaacccctgaataacgacgaagatcatgcgcactggaccgaggctaaaatgcttctggacaatatcaacacacctgaggggattatccccgccctcttcgaacctgagagagaaaagtccgccgctattgatggagagtaccggctgcgcggcgaagccagaaagacctttgtcgagctgatgcggcgcggggacctcccggtgtggctttcttataaagttgcgagcgagggcttccagtactccgatagacggtggtgctttgacggagaaagaaataaccaggtgctggaggaaaatatggacgtcgagatctggacgaaggaaggcgagcgcaaaaagctgcggcccagatggctcgatgcccgcacatatagcgaccctctggcccttcgggagttcaaagaatttgccgctgggagacggtctgtgtccggagatctgatcctcgagattggcaagctgccccagcatctgaccctccgcgcccaaaacgctcttgacaatctggtcatgctgcacaacagcgaacaagggggaaaagcctacagacacgcgatggaggaactccctgataccatcgagacactgatgcttctggccctcattgctgtgctgaccggcggcgttacactgttctttctctccgggaagggacttggcaagacgtctatcgggctgctgtgtgtgatggccagctccgtgctcctgtggatggcttctgtcgagccccattggattgccgccagcatcatccttgagttctttctgatggttctcctgattccggagcctgaccggcagcgcacaccccaggataaccaactggcttatgtggtgatcggactccttttcatgattctgacagtcgcggccaatgaaatgggcctgctcgagaccaccaagaaggacctggggatcggacacgtggttgctgagaaccatcaccacgccaccatgcttgatattgacctgcatcctgcctccgcttggacgctctacgccgtggcgaccacaatcattacccccatgatgagacacacaatcgaaaataccacggccaacatcagcctgacagctattgccaatcaggctgccatcctgatgggcctcgataaaggctggcctatttctaagatggacatcggggtcccccttctggcgctgggatgctactcccaggtgaacccgctcaccctgacagccgctgtccttatgctggtggcccattatgctattatcggccctgggctccaagccaaagctacccgggaggcccagaagcgcaccgcggccggaatcatgaagaatcccacagttgatggcattgtggctatcgacctggaccccgtcgtgtacgatgccaaatttgaaaagcagctggggcagattatgctccttatcctgtgtacgagccaaattctgctcatgagaaccacatgggctctgtgcgagtctatcacccttgccacaggacctctgaccacgctctgggaaggctccccgggcaaattctggaacacaaccatcgccgttagcatggcgaatattttccgggggtcttatctggctggagccggcctggcttttagcctcatgaagtcccttgggggaggccgcagagacaccggggcccagggagagacactgggcgagaaatggaagcggcagctgaaccagctctctaagcccgagttcaatacctacaaaagaagcggcatcatggaggtggatcgctccgaagccaaggaggggctgaaacggggagaaacaacgaagcacgctgtcagcagaggcaccgccaaacttcgctggtttgtggagcggaacctggtgaagcctgaggggaaggttattgacctcggatgtggcagagggggatggtcctattactgcgcgggcctgaaaaaggtcacagaagtgaaaggctataccaaagggggacccggccatgaggaacctatccccatggccacatacgggtggaatattgtgaaactgcactctggaaaggatgtcttctttacccctccggagaaatgtgacacgctcctttgcgatatcggcgaaagctcccccaaccctaccattgaggaggggcgcacactgcgggttctgaagatggtggaaccctggctcagaggaaatcaattctgtatcaagatcctgaacccttacatgccctctgtggtcgagacccttgaacagatgcagcgcaaacacggcggcatgctggtgcggaatccgctcagcagaaactccacacatgagatgtattgggtttcttgcgggaccggaaacattgtgagcgctgtcaatatgacatcccgcatgctgctgaaccggtttaccatggcccacagaaagcctacgtacgagcgcgacgtggatctcggcgctgggacaagacatgttgccgtggaacccgagatcgcgaatctggacattatcggacagcggatggaaaacattaaaaatgagcacaagagcacctggcactatgatgaagacaacccctacaaaacctgggcctatcatggctcttacgaggtcaagccttccgggagcgcttcttccatggtgaatggagtggtccgccttctgacaaagccctgggacgttatccctatggtgacgcaaatcgccatgaccgatacaaccccgttcggccagcagagagtgtttaaagagaaggtcgacacacggacccccagacctaaacggggcacagctcaaattatggaagtgaccgccaagtggctctgggggttcctgagccgcaacaaaaagcccagaatctgtacgcgggaggaatttacccgcaaggttagatctaatgctgccattggagcggtgttcgtcgatgagaaccagtggaactccgccaaagaagctgtggaggacgagcggttttgggatcttgttcaccgcgaaagagagctgcataagcagggcaaatgcgccacatgcgtgtataacatgatggggaagcgggagaagaagctcggagagttcggcaaggctaaagggagccgcgccatctggtacatgtggctgggcgccagattcctggaatttgaggcgctcggattcatgaatgaggaccactggttttcccgggaaaacagcctgtctggcgtcgagggggaaggactttacaagctgggctatattctccgcgatatcagcaaaatccctgggggaaatatgtacgctgacgataccgccggctgggacacaagaattaccgaggatgacctgcagaacgaggccaagatcacggatattatggaacccgagcatgcccttctggccacatccatcttcaaactcacctatcaaaacaaggtggttcgggtgcagcgcccggctaaatctgggacagtcatggacgtgattagcagacgggaccagagaggctccggacaggtcggcacctacgggctgaatacgtttaccaacatggaagtgcaactgatccgccagatggagtctgaaggaatcttcagcccttccgagctcgaaaattctaacctggccgaacgggttcttgattggctggagaagcacggcgtggaaagactcaagcgcatggcgattagcggggacgattgtgtcgtgaaacccacagacgatcggtttgccaccgctctgacagcccttaatgacatgggaaaggtgagaaaagatatccctcagtgggagccctccaagggctggaacgactggcagcaagttcctttctgcagccaccattttcaccagctgattatgaaagatgggcgcgaaatcgtggtcccctgtcggaatcaggacgagctcgtgggcagagctcgcgtttctcagggagccggctggtccctgcgggagaccgcgtgcctgggaaagagctatgcccaaatgtggcagctcatgtacttccatagacgcgatctgcggcttgctgccaacgctatttgttctgccgtgccggtcaattgggtgcctacatccagaaccacgtggagcatccacgctcaccatcagtggatgacaaccgaagacatgctgtccgtctggaaccgggtgtggattgaggaaaatccctggatggaggacaagacccacgtttctagctgggaagatgtgccctatctcgggaaaagagaggaccaatggtgcggctccctgatcgggcttacagcccgcgcgacctgggccacaaacatccaggtcgctattaatcaggtgcggagactgatcggaaacgagaattacagcgattacatgacgtctatgaagcgctttaaaaacgaatccgaccctgagggcgccctctggtga

SEQ ID NO: 18484 - RNA, 9879 nt, synthetic construct
  misc_feature 1..9879: note = derived and/or modified CDS sequence (opt5) from DENV-1__JN903581__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctttctctacacaagacgaaaagggggtgacccagaacggacggctcatcacagctaatcccatcgtgacggataaagagaagcctgttaacattgaaaccgagccgccctttggcgagtcctatatcgtcattggggccggagaaaaagccctgaagctgagctggttcaagaaaggctctagcatcgggaagatgtttgaggctacagccagaggcgctcgccggatggccattctcggagacaccgcgtgggatttcggctccatcgggggagtgtttacatctgtgggcaaactggtccatcaggtgttcgggaccgcctacggagttctttttagcggcgtgtcctggacgatgaagatcgggattggcatcctgctcacctggctgggactgaatagcagaaacacatctctttccatgacctgtattgctgtcggcatggtgacactctacctgggggttatggtgcaggccgacaccggatgcgtcatcaactggaaaggccgcgaactgaagtgtgggagcggaattttcgtgacaaatgaggttcacacctggacggaacaatataagtttcaggctgattctcctaaacggctctccgccgcgatcggcaaggcctgggaggagggggtgtgcggcattagaagcgctacacgcctggaaaacatcatgtggaaacagatctccaatgagcttaaccatattctgctcgaaaatgacatgaagttcaccgtcgtggtgggagacgccaacggcatcctgacccaggggaaaaagatgattcggccgcaacccatggagcacaaatactcttggaaaagctggggaaaggctaagatcattggcgccgatacacagaataccacgtttatcatcgacgggcctgatacacccgaatgtcctgacgatcagagagcctggaacatttgggaggtcgaggactatggattcggcatctttaccacaaatatttggctgaaacttcgcgattcctacacccagatgtgcgaccaccggctcatgtctgctgttatcaaagatagcaaggcggtgcatgccgacatgggctattggattgaatccgagaaaaacgaaacatggaagctggctagagccagcttcatcgaggtgaagacctgtatctggccccgctctcacacgctgtggtccaatggggtcctcgaaagcgagatgattatcccgaaaatttacggaggccctatctctcaacataactatcggcccgggtacttcacccagacagccggaccttggcacctgggcaaacttgagctggattttaatctctgcgaagggaccacagtggttgtggacgagcactgcggaaacagaggcccctccctgcggaccacgacagtcaccggcaaaattatccatgaatggtgttgccgcagctgtacactgcctccccttagattcagaggggaagatggatgctggtacggcatggagatcagaccggtgaaggaagaggaagagaatctcgttcgctctatggtgagcgctgggtccggagaagtcgacagcttttctctgggcctgctctgtgtgtccattatgatcgaggaggttatgaaaagccggtggtccagaaagatgctgatgaccgggacccttgccgtgttctttctgctcattatgggacagctgacatggaacgacctgatccgcctttgcattatggtcggcgcgaacgtgtctgatagaatgggcatggggacgacctatctggctctcatggccacattcaagatgcggcctatgtttgccgtgggactcctgttccgcagactgaccagccgggaagtccttctgctcacaatcggcctgtccctggttgcttctgccgagcttcccaatagcctggaggaactcggggacggactggcgatgggcattatgatgctcaaactgcttgctgattttcaatcccaccagctgtggaccacgctcctgtctctgacattcatcaagaccacccttagcctggactacgcctggaaaacaatcgccatgattctctccatcgtgagcctgtttcccctctgtctgtctaccacatcccagaagacgacctggcttcctgtgctgctggggagcttcggatgcaaaccgctcacaatgtttctgattaccgaaaacaagatctggggccgcaagtcttggccccttaatgagggcattatggctgtcgggatcgtgtccatcctgctcagctctctgctcaaaaacgatgttcctctggccggaccccttattgctggcgggatgctgatcgcctgttatgtgatttccggaagctccgcggacctgagcctcgagagagccgctgaagtctcttgggaggaagaggccgaacatagcggcgcttcccacaatatcctggtggaggttcaggatgacgggacaatgaagattaaagatgaggaacgggacgatacccttacgatcctgctcaaggccaccctgctcgccatctctggagtgtaccctatgagcattcccgctacactgttcgtctggtatttctggcagaagaagaaacagcgctccggcgtgctttgggacaccccttctcccccggaggtcgaaagagcggtgctggatgacggcatctaccggattctgcagcgcgggctcctgggaagaagccaggttggcgtgggggtctttcaagacggagtgttccatacaatgtggcacgttacccggggcgccgtgcttatgtatcaggggaagagactggagccttcctgggcttctgtcaagaaagatctcatcagctacggaggcggctggcgctttcaggggtcctggaacacaggagaggaagtgcaagtgattgccgttgagcccggcaagaatcctaaaaacgtccaaacgacccccgggacattcaagaccccggaaggagaggtgggcgccatcgctctggactttaaacctgggaccagcggatctcccattgtgaatcgggaaggcaagatcgtcggcctctacggggatggagtggttacaacgtccggcacctatgtgagcgccatcgcgcaggctaaggcctctcaggaggggcctctgcccgagattgaagacgaggtcttcaaaaagagaaaccttacaatcatggatctgcaccccggatccggcaaaacccgccggtacctgcctgccattgtgagagaagctatcaagcgcaaactccggacactgattcttgccccgaccagagttgtggcgagcgagatggctgaagccctgaaggggatgcccatccgctatcaaacgacagccgtcaagtccgagcataccggccgggagatcgtggacctcatgtgccacgctacctttacaatgagactgctgtctcctgttcgggtgcccaattacaacatgattatcatggatgaagcccatttcaccgaccctgctagcattgccgcgcgcggatatatctccacaagagtcggcatgggggaggccgctgccatttttatgaccgctacgccccctggaagcgtggaagccttcccgcagtctaatgccgtgatccaggatgaggaacgggacatccccgagcgctcctggaacagcggctacgattggattacagactttcctgggaaaaccgtctggttcgttccctctatcaagagcggaaatgacattgctaactgtctccgcaagaacggcaagcgggtgatccagctttccagaaaaacattcgataccgagtatcaaaagacgaagaataacgactgggattacgtggtcaccacagacatttctgaaatgggggcgaattttcgcgccgatcgggtgatcgaccctagacgctgcctggagcccgttattctgaaagatggcccggaacgggtgatcctcgctggacctatgcccgtcaccgccgccagcgctgcccagagacgcggccggatcgggagaaaccagaataaggagggagaccagtacatttatatgggccaacccctgaacaatgatgaggaccacgcgcattggacagaagctaaaatgcttctggataacatcaatacccctgaggggattatccccgccctcttcgaacctgagcgcgaaaagtccgccgctattgacggagagtacagactgcggggcgaggcccgcaaaacatttgtggaactgatgagaagaggggatctcccggtttggctttcttataaggtggcgagcgagggcttccagtactccgaccgcagatggtgctttgacggagaacggaacaatcaggtcctggaggaaaacatggatgtggagatctggaccaaggagggcgaacgcaagaagctgcgcccccggtggctcgacgccagaacgtatagcgatcctctggctcttagagagttcaaagaatttgccgctgggcggagatctgtctccggagacctgatcctcgagattggcaagctgccccagcacctgacactccgggcccaaaatgctcttgataacctggtgatgctgcacaatagcgaacaagggggaaaagcctaccgccatgcgatggaggagctccctgacaccatcgaaaccctgatgcttctggccctcattgctgttctgacaggcggcgtgaccctgttctttctctccgggaagggacttggcaaaacatctatcgggctgctgtgtgtgatggccagctccgtcctcctgtggatggcttctgttgagccccactggattgccgccagcatcatccttgagttctttctgatggtgctcctgattccggagcctgatagacagcggacgccccaggacaaccaactggcttatgtggtcatcggactccttttcatgattctgaccgtggcggccaacgagatgggcctgctcgaaacaaccaagcgcgatctggggatcggacatgttgtggctgagaatcaccaccatgccacaatgcttgacattgatctgcaccctgcctccgcttggaccctctacgccgtcgcgacgaccatcattacacccatgatgagacataccatcgaaaacacaaccgccaatatcagcctgacggctattgccaaccaggctgccatcctgatgggcctcgacaagggctggcctatttctaaaatggatatcggggtgccccttctggcgctgggatgctactcccaggtcaatccgctcacactgaccgccgctgtgcttatgctggttgcccactatgctattatcggccctgggctccaagccaaggctacacgggaggcccagaaacgcaccgcggccggaatcatgaagaaccccaccgtggacggcattgtcgctatcgacctggatcccgtggtttacgacgccaaatttgaaaagcagctggggcagattatgctccttatcctgtgtacaagccaaattctgctcatgagaacgacctgggctctgtgcgagtctatcacacttgccaccggacctctgacaaccctctgggagggctccccgggcaagttctggaatacgacaatcgccgtgagcatggcgaacattttccgggggtcttatctggctggagccggcctggcttttagcctcatgaaatcccttgggggaggccgcagagggaccggagcccagggcgaaaccctgggcgagaagtggaaacggcagctgaatcagctctctaagagcgagttcaacacatacaaaagatccgggatcatggaggtcgatcgcagcgaagccaaggagggactgaagcggggcgagaccacaaaacatgctgtgtccagagggacggtgaaacttcgctggtttgttgaacggaatctggtcaaacccgagggaaaggtgattgacctcggctgtgggagaggaggctggtcttattactgcgccggcctgaaaaaggtgaccgaagtcaaggggtatacaaaaggaggccctgggcacgaggaacccatccctatggcgacctacggatggaacattgttaagctgcacagcggcaaagatgtgttctttacaccccctgagaagtgtgacaccctcctttgcgatatcggggagtcctctccgaatcccacgattgaagagggacgcaccctgcgggtgctgaaaatggtcgaaccttggctcagaggcaaccaattctgtatcaagatcctgaatccctacatgcctagcgtggttgagacacttgagcagatgcagcgcaaacatggcgggatgctggtgcggaaccccctctccagaaattctacccacgaaatgtattgggtcagctgcggaacaggcaacattgtgtccgccgttaacatgaccagccgcatgctgctgaatcggtttacaatggctcatagaaagccgacctacgagcgcgacgtggatctcggggccggaacgagacacgtcgctgtggaacctgagatcgccaacctggacattatcggccagcggattgaaaatatcaagaacgagcacaaatctacatggcattatgatgaggacaatccctacaagacctgggcgtatcacgggtcctacgaagtgaaacccagcggatctgcctccagcatggtcaacggcgttgtgcgccttctgaccaagccttgggacgtgatccccatggtcacacaaattgctatgacggataccacacctttcggccagcagagagtgtttaaagagaaggttgacacccggacaccgagacccaagcgggggaccgcccaaatcatggaagtgacagctaaatggctctggggattcctgtctcgcaataagaaacctagaatttgtacccgggaggaatttacgcgcaaggtcagatccaacgccgctatcggcgccgtgttcgttgatgagaatcagtggaacagcgcgaaagaggccgtggaagacgagcggttttgggatcttgtccatcgcgaaagagagctgcacaagcaggggaagtgcgctacctgcgtgtataatatgatgggaaaacgggaaaagaaactcggcgagttcgggaaggccaaaggctcccgcgctatttggtacatgtggctgggagccagattcctggagtttgaagccctcggcttcatgaacgaggaccattggtttagccgggaaaattctctgagcggggttgagggagagggcctttacaagctggggtatatcctccgcgatatctccaagattcccggaggcaacatgtacgcggacgatacagctgggtgggacaccagaatcacagaagatgacctgcagaatgaggccaaaattaccgatatcatggaacctgagcacgcccttctggctacgtctattttcaagctcacatatcaaaacaaagtggtccgggtgcagcgccccgccaagagcggcaccgtcatggacgtgatctccagacgggaccagagaggatctggccaggttgggacatacggactgaacacctttacgaatatggaagtgcaactgatccgccagatggagagcgagggcattttctccccgtctgaactcgagaacagcaatctggctgaacgggtccttgattggctggagaaacacggggtggaaagactcaagcgcatggccatctccggagacgattgtgtggttaaacctaccgacgatcggtttgcgacagccctgaccgctcttaacgacatgggcaaggtgagaaaggatattccccagtgggagcctagcaaagggtggaatgactggcagcaagtccccttctgctctcatcactttcatcagctgatcatgaaggatggccgcgagattgtggttccttgtcggaaccaggacgaactcgtgggacgggcccgcgtctcccagggcgctgggtggagcctgcgggagacagcctgcctgggaaaatcttatgcgcaaatgtggcagctcatgtacttccacagacgcgatctgcggcttgccgctaatgccatctgttccgctgtgcccgtcaactgggtgccgaccagcagaacaacctggtccattcacgcccatcaccagtggatgacgacagaagacatgctgtctgtttggaatcgggtgtggatcgaggaaaacccttggatggaggacaagacccatgtcagctcctgggaggatgtgccctatctcggcaaaagagaagaccaatggtgcgggagcctgatcggacttaccgctcgcgccacatgggcgaccaatattcaggttgccatcaaccaggtgcggagactgattggcaatgagaactactctgattacatgacatccatgaagcgctttaagaatgaaagcgaccccgagggggctctctggtga

SEQ ID NO: 18485 - RNA, 9879 nt, synthetic construct
  misc_feature 1..9879: note = derived and/or modified CDS sequence (opt5) from DENV-1__KX380796__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagatgcagaaagttgaaacatgggctcttagacaccccggcttcaccgtgattgccctgtttctcgcgcatgccatcgggacatctattacccagaagggaatcatcttcattctgcttatgctggtcacccctagcatggctatgagatgcgtgggcatcgggaaccgggattttgttgagggactctccggcgccacatgggtggacgtcgtgctggagcacgggagctgtgtgacgaccatggctaagaataaacccacactggatattgaactcctgaagaccgaggtcacaaaccctgccgttcttcgcaaactgtgcatcgaagcgaagatttctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagacggttcagtacgaaaacctgaaatattctgtgatcgtcaccgtgcacacaggcgatcagcatcaagttgggaatgagaccacagaacacggaaccattgctacgatcacaccccaagcccctacatccgagatccagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggctagcacctcccaagagacatggaatcgccaggatctgctggtgaccttcaaaaccgcgcacgccaagaagcaggaagtcgtggttctcggatctcaagagggcgctatgcacacagccctgacgggggccaccgaaattcagacaagcggaaccacaaccatctttgctggccatcttaaatgcagactgaagatggacaaactcacgctgaagggggtgtcctatgtcatgtgtacaggcagcttcaaactggagaaggaagtggccgagacccagcacggaaccgttcttgtgcaggtcaagtacgagggcacagatgcgccgtgcaaaattcctttctctacccaagacgaaaagggggtgacacagaacggacggctcatcacggctaatcccattgtgaccgataaagagaagcctgttaacatcgaaacagagccgccctttggcgagtcctatatcgtcattggggccggagaaaaagccctgaagctgagctggttcaagaaaggctctagcatcgggaagatgtttgaggctaccgccagaggcgctcgccggatggccattctcggagacacagcgtgggatttcggctccatcgggggagtgtttacctctgtgggcaaactggtccatcaggtgttcgggacggcctacggagttctttttaatggcgtgagctggaccatgaagattgggatcggcatcctgctcacatggctgggactgaactccagaagcacctctctttccatgacatgtattgctgtcggcatggtgaccctctacctgggggttatggtgcaggccgacagcggatgcgtcatcaactggaaaggccgcgaactgaagtgtgggtctggaattttcgtgacaaatgaggttcacacctggacggaacaatataagtttcaggctgattcccctaaacggctcagcgccgcgatcggcaaggcctgggaggagggggtgtgcggcattagatccgctacacgcctggaaaacatcatgtggaaacagatttctaatgagcttaaccatatcctgctcgaaaatgacatgaagttcaccgtcgtggtgggagacgccaacggcatcctgacccaggggaaaaagatgattcggccgcaacccatggagcacaaatacagctggaagtcctggggaaaggctaaaatcattggcgccgatacacagaataccacgtttatcattgacgggcctgatacacccgaatgtcctgacgatcagagagcctggaacatctgggaggtcgaggactatggattcggcgtttttaccacaaatatctggctgaaacttcgcgattcttacacccagatgtgcgaccaccggctcatgagcgctgcgattaaagattccaaggccgtgcatgctgacatgggctattggatcgaaagcgagaaaaacgaaacatggaagctggccagagcctctttcattgaggtgaagacctgtatctggccccgctcccacacgctgtggagcaatggggtcctcgaatctgagatgattatcccgaaaatctacggaggccctatttcccaacataactatcggcccgggtacttcacccagacagctggaccttggcacctgggcaaacttgagctggattttgacctctgcgaagggaccacagtggttgtggatgagcactgcggaaatagaggccccagcctgcggaccacgacagtcaccggcaaaatcattcatgaatggtgttgccgctcttgtacactgcctccccttagattcagaggggaagacggatgctggtacggcatggagatccggccggtgaaggaaaaagaggaaaacctcgttcgcagcatggtgtccgccgggagcggagaggtcgactctttttccctgggcctgctctgtgtgagcattatgatcgaagaggttatgcggtccagatggtctcgcaagatgctgatgaccgggacccttgcggtgttctttctgctcatcatgggacagctgacatggaatgatctgattagactttgcatcatggtcggcgctaacgtgagcgaccggatgggcatggggacgacctatctggccctcatggccacattcaagatgcgccctatgtttgctgtgggactcctgttcagacggctgacctcccgcgaggtccttctgctcacaattggcctgtctctggttgccagcgtggaacttcccaactccctggaggaactcggggatggactggcgatgggcatcatgatgctcaaactgcttaccgactttcaaccccaccagctgtggacgacactcctgtctctgaccttcattaagaccacacttagcctggattacgcttggaaaaccatggccatggtgctctccatcgtcagcctgtttcctctctgtctgtctacaacgtcccagaagaccacatggcttccggtgctgctggggagcttcggatgcaaacccctcaccatgtttctgattacagagaataagatctggggcagaaagtcttggcctcttaacgaaggcatcatggccgttgggattgtgtccatcctgctcagctctctgctcaaaaatgacgtccccctggctggacctcttattgccggcgggatgctgatcgcttgttatgtgatttccggaagctccgccgatctgagcctcgagcgggcggccgaggtttcttgggaagaggaagctgagcatagcggcgcctcccacaacatcctggtggaagtccaggacgatgggaccatgaagatcaaagacgaggagcgcgatgacacgcttaccattctgctcaaggctacactgctcgccgtgtctggagtctaccccatgagcatccctgccaccctgttcgtgtggtatttctggcagaagaagaaacagagatccggcgttctttgggatacaccctctccgcctgaagtggagcgggctgtcctggacgacggcatttaccgcatcctgcagagagggctcctgggacggagccaggtgggcgttggggtgtttcaagatggagtcttccataccatgtggcacgtgacaagaggcgcggtgcttatgtatcaggggaaacgcctggaaccctcctgggcctctgttaagaaagacctcattagctacggaggcggctggcggtttcaggggtcctggaatacgggagaggaggtccaggtgatcgctgtggaacctggcaagaaccccaaaaatgtccaaaccacaccggggaccttcaagacccctgagggagaagtgggcgccatcgccctggattttaaacccgggacaagcggatctcctattgttaacagagagggcaagatcgtgggcctctacgggaatggagtcgtgacgacctccggcacatatgttagcgctattgcccaggcgaaggcttctcaggaagggcccctgcccgagatcgaggacgaagtgttcaaaaagcgcaaccttaccattatggatctgcaccctggatccggcaaaacacggagatacctgccggccatcgtccgcgaggccattaagcggaaactcagaaccctgatccttgctcccacgcgcgtggttgccagcgaaatggcggaggctctgaaggggatgcctatccggtatcaaacaaccgccgtgaagtccgaacataccggcaaagagattgtcgacctcatgtgccacgccacatttaccatgagactgctgtctcccgtgcgggtgcctaattacaacatgatcattatggatgaggctcatttcacagaccccgccagcatcgctgcccgcggatatatttccaccagagtcggcatgggggaagcggccgctatctttatgacggccacacctccgggaagcgttgaggctttcccccagtctaatgccgtgatccaggatgaagaacgggacattcctgaacgctcctggaacagcggctacgattggatcaccgactttcccgggaagacagtgtggttcgtcccttctattaaaagcggaaatgacatcgccaactgtctcagaaagaacggcaaacgggtgattcagctttccagaaagaccttcgatacggagtatcaaaagaccaaaaataacgactgggattacgttgtgacaaccgacatctctgagatgggggctaattttcgcgcggatcgggtcatcgaccccagacgctgcctgaagccggtgattctgaaagatggccctgaacgggttatcctcgccggacccatgcccgtgacagctgccagcgccgctcagagacgcggccggattgggagaaaccagaataaggagggagaccagtacatctatatgggccaacctctgaacaatgatgaagaccacgcccattggaccgaggcgaaaatgcttctggataacattaatacacccgaggggatcattcctgctctcttcgaaccggagcgcgaaaagtccgccgccatcgacggagagtacagactgcggggcgaagctcgcaagacctttgtcgagctgatgagaagaggggatctccccgtgtggctttcttataaagtcgccagcgagggcttccagtactccgaccgcagatggtgctttgacggagaacggaacaatcaggtgctggaggaaaacatggatgttgagatctggacgaaggaaggcgagcgcaagaagctgcgccctcggtggctcgacgcgagaacatatagcgatcccctggcccttcgcgagttcaaagaatttgctgccgggcggagatctgtgtccggagacctgattctcgagatcggcaagctgcctcagcacctgaccctccgggctcaaaatgcccttgataacctggtgatgctgcacaatagcgaacaagggggaaaggcttaccgccatgccatggaggaactccccgacaccattgagacactgatgcttctggcgctcatcgccgtcctgaccggcggcgttacactgttctttctctccgggaagggacttggcaagacgtctattgggctgctgtgtgtgatggctagctccgtgctcctgtggatggcctctgtcgagccgcactggatcgctgccagcatcattcttgagttctttctgatggtgctcctgatccctgagcccgatagacagcggacccctcaggacaaccaactggcctatgttgtgattggactccttttcatgatcctgacagtcgctgcgaacgaaatgggcctgctcgagaccaccaagaaggatctggggattggacatgtggtcgccgagaatcaccaccatgctaccatgcttgacatcgatctgcaccccgcctccgcctggacgctctacgctgtggccaccacaatcattacccctatgatgcgccatacaatcgaaaacaccacggcgaatattagcctgacagccatcgctaaccaggccgctattctgatgggcctcgacaaaggctggcccatctctaagatggatattggggttccgcttctggccctgggatgctactcccaggtgaatcctctcaccctgacagcggccgtccttatgctggtggctcactatgccatcatcggccccgggctccaagctaaagccaccagagaggctcagaagcggaccgccgcgggaattatgaagaaccccacagttgacggcatcgtggccattgacctggatcctgtcgtgtacgacgctaaatttgaaaagcagctggggcagatcatgctccttattctgtgtacgagccaaatcctgctcatgcgcaccacatgggccctgtgcgagtctatcacccttgctacaggaccgctgaccacgctctgggaaggctcccccggcagattctggaatacaaccattgccgtgagcatggccaacatcttccgggggtcttatctggcgggagctggcctggcctttagcctcatgaaatcccttgggggaggccgcagagggaccggagctcagggcgagacactgggcgagaagtggaaacggcagctgaatcagctctctaagagcgagttcaacacctacaagagatccgggattatggaggttgatcgcagcgaagccaaagagggactgaagcggggcgaaacaacgaaacatgccgtctccagagggaccgctaaacttcgctggtttgtggagcggaatctggtgaaacctgagggaaaggtcatcgacctcggctgtgggagaggaggctggtcttattactgcgccggcctgaagaaagttacagaagtgaaggggtataccaaaggaggccccgggcacgaggaacctattcccatggcgacatacggatggaacatcgtgaagctgcacagcggccgcgatgtcttctttacccctccggagaaatgtgacacgctcctttgcgatatcggggaatcctctcccaatcctaccattgaggagggacggacactgagagtgctgaagatggttgaaccctggctccgcggcaaccaattctgtatcaaaattctgaatccttacatgcccagcgtggtcgagacccttgaacagatgcagcggaagcatggcgggatgctggtgagaaacccgctctcccgcaattctacacacgagatgtattgggttagctgcggaaccggcaacatcgtgtccgccgtcaacatgacaagccggatgctgctgaatagatttaccatggctcatcgcaagcctacgtacgagagagacgtggatctcggggccggaacacggcacgtggctgtcgaacccgagattgccaacctggacatcattggccagcgcatcgaaaatatcaaaaacgagcacaagtctacctggcattatgatgaagacaatccctacaaaacctgggcgtatcacgggtcctacgaggttaagcctagcggatctgcctccagcatggtgaacggcgtggtcagacttctgacaaaaccctgggacgtgattcctatggttacgcaaatcgctatgaccgatacaaccccgttcggccagcagcgggtgtttaaggagaaggtcgacacaagaacaccccggcctaaacgcgggacagcccaaattatggaagtgaccgctaagtggctctggggattcctgtctagaaataaaaagccccggatctgtacgcgcgaggaatttaccagaaaagttcggtccaacgccgctattggcgccgtgttcgtcgatgagaatcagtggaacagcgcgaaggaagccgtggaggacgagcgcttttgggatcttgttcatagagaacgggagctgcacaagcaggggaaatgcgctacatgcgtgtataatatgatgggaaagcgcgagaaaaagctcggcgagttcgggaaagccaagggctccagagctatctggtacatgtggctgggagcccggttcctggaatttgaggccctcggcttcatgaacgaggaccattggtttagccgcgaaaattctctgagcggggtcgagggagaaggccttcacaagctggggtacatcctcagagatatttccaaaatccctggaggcaacatgtatgcggacgataccgctgggtgggacacacggattaccgaggatgacctgcagaatgaggccaagatcacggatattatggaacccgagcacgcccttctggctacatctatcttcaaactcacctaccaaaacaaggtggtccgcgtgcagagaccggccaaaagcggcacagttatggacgtgatctcccggagagaccagcgcggatctggccaggtcgggacctatggactgaacacgtttaccaatatggaagtgcaactgattcggcagatggagagcgaaggcatcttctccccttctgagctcgagaacagcaatctggctgaaagagtgcttgattggctggagaagcatggggttgaacgcctcaaacggatggccatttccggagacgattgtgtggtcaagcccacagacgatagatttgcgaccgccctgacagctcttaacgacatgggcaaggtgcgcaaagatatccctcagtgggagcccagcaaggggtggaatgactggcagcaagttcctttctgctctcaccattttcaccagctgattatgaaagatggccgggaaatcgtggtcccctgtagaaaccaggacgagctcgtgggacgcgcccgggtctcccagggcgctgggtggagcctgagagagaccgcctgcctgggaaagtcttacgcgcaaatgtggcagctcatgtatttccaccgccgggatctgagacttgccgctaatgccatctgttccgctgtgccggttaactgggtgcctacaagccggaccacgtggtccattcatgcccaccatcagtggatgacaaccgaagacatgctgtctgtctggaatagagtgtggatcgaggaaaacccctggatggaggacaaaacccacgttagctcctgggaagatgtgccctacctcggcaagcgcgaggaccaatggtgcgggagcctgattggacttacagctcgggccacctgggcgacaaatatccaggtcgccattaaccaggtgagacgcctgatcggcaatgagaactatctcgattacatgacgtctatgaagagatttaaaaatgaatccgaccctgagggggctctgtggtga

SEQ ID NO: 18486 - RNA, 9879 nt, synthetic construct
  misc_feature 1..9879: note = derived and/or modified CDS sequence (opt5) from DENV-1__KX380799__SS-prME
  source 1..9879: mol_type = other RNA
agcgtgaccatgctgctcatgctgcttcccacagccctggctttccacctcacgacccggggcggggaacctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatccggccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagctgcgcccccggtggctcgatgcgagaacgtattccgaccctctggcccttcgcgagtttaaagagttcgctgccgggcggagaagcgtgtccggagatctgatcctcgagattggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcatcgccgtcctgacaggcggcgttaccctgtttttcctcagcgggaagggacttggcaagacatccattgggctgctgtgtgtgatggcttctagcgtgctcctgtggatggcctccgtcgagccccactggatcgctgccagcattatccttgaatttttcctgatggtgctcctgattccggagcctgacagacagcggacgccccaggataaccaactggcctatgttgtgatcggactcctttttatgatcctgaccgtcgctgcgaacgaaatgggcctgctcgagacaaccaaaaaggacctggggattggacatgtggtcgccgagaatcaccaccatgctacaatgcttgatatcgacctgcaccctgcctctgcctggaccctctacgctgtggccacgaccattatcacacccatgatgcgccataccattgaaaacacaaccgcgaatatctccctgacggccattgctaaccaggccgctatcctgatgggcctcgataaaggctggcctatcagcaagatggacattggggttccccttctggccctgggatgctactctcaggtgaatccgctcacactgaccgcggccgtccttatgctggtggctcactatgccatcattggccctgggctccaagctaaagccacaagagaggctcagaagcggaccgccgcgggaatcatgaagaaccccaccgttgatggcattgtggccatcgacctggaccccgtcgtgtacgatgctaaattcgaaaagcagctggggcagatcatgctccttattctgtgtacatcccaaatcctgctcatgcgcacgacctgggccctgtgcgagagcattacacttgctaccggacctctgacaaccctctgggaaggctctccgggcagattttggaatacgacaatcgccgtgagcatggccaacattttccgggggtcctatctggcgggagctggcctggccttctctctcatgaaaagccttgggggaggccgcagagggaccggagctcagggcgagaccctgggcgagaagtggaaacggcagctgaatcagctctccaagagcgaatttaacacatacaagagatccgggatcatggaggttgaccgctctgaagccaaagagggactgaagcggggcgaaaccacaaaacatgccgtcagcagagggacggctaaacttcgctggttcgtggagcggaatctggtgaaacccgagggaaaggtcatcgatctcggctgtgggagaggaggctggtcctattactgcgccggcctgaagaaagttaccgaagtgaaggggtatacaaaaggaggccctgggcacgaggaacccattcctatggcgacctacggatggaacatcgtgaagctgcactctggccgcgacgtctttttcacaccccctgagaaatgtgataccctcctttgcgacattggggaaagctccccgaatcccacgatcgaggagggacggaccctgagagtgctgaagatggttgaaccttggctccgcggcaaccaattttgtattaaaatcctgaatccctacatgccttctgtggtcgagacacttgaacagatgcagcggaagcatggcgggatgctggtgagaaaccccctcagccgcaattccacccacgagatgtattgggttagctgcggaacaggcaacattgtgtctgccgtcaacatgacctcccggatgctgctgaatagattcacaatggctcatcgcaagccgacctacgagagagatgtggacctcggggccggaacgcggcacgtggctgtcgaacctgagatcgccaacctggatatcattggccagcgcatcgaaaatattaaaaacgagcacaagagcacatggcattatgacgaagataatccctacaaaacctgggcgtatcacgggtcttacgaggttaagccctccggaagcgcctcttccatggtgaacggcgtggtcagacttctgaccaaaccttgggacgtgatccccatggttacacaaattgctatgacggacaccacaccttttggccagcagcgggtgttcaaggagaaggtcgataccagaacaccgcggcccaaacgcgggaccgcccaaatcatggaagtgacagctaagtggctctggggatttctgagcagaaataaaaagcctcggatctgtacccgcgaggagttcacgagaaaagttcggtccaacgccgctattggcgccgtgtttgtcgacgagaatcagtggaacagcgcgaaggaagccgtggaggatgagcgcttctgggaccttgttcatagagaacgggagctgcacaagcaggggaaatgcgctacctgcgtgtataatatgatgggaaagcgcgagaagaagctcggcgagtttgggaaagccaagggctctagagctatctggtacatgtggctgggagcccggttcctggagttcgaggccctcggctttatgaacgaggatcattggttcagccgcgaaaattccctgtctggggtcgagggagaaggccttcacaagctggggtacattctcagagacatcagcaaaattcccggaggcaacatgtatgcggatgacacagctgggtgggatacccggatcacagaggacgatctgcagaatgaggccaagatcaccgacattatggaacctgagcacgcccttctggctacgtccatctttaaactcacataccaaaacaaggtggtccgcgtgcagagacccgccaaatctggcaccgttatggatgtgattagccggagagaccagcgcggatccggccaggtcgggacatatggactgaacaccttcacgaatatggaagtgcaactgatccggcagatggagtctgaaggcatttttagcccgtccgagctcgagaacagcaatctggctgaaagagtgcttgactggctggagaagcatggggttgaacgcctcaaacggatggccatctctggagatgactgtgtggtcaagcctaccgatgacagattcgcgacagccctgaccgctcttaacgatatgggcaaggtgcgcaaagacatcccccagtgggagccttccaaggggtggaatgattggcagcaagttcccttttgcagccaccatttccaccagctgattatgaaagacggccgggaaatcgtggtcccttgtagaaaccaggatgagctcgtgggacgcgcccgggtctctcagggcgctgggtggtccctgagagagacagcctgcctgggaaagagctacgcgcaaatgtggcagctcatgtattttcaccgccgggacctgagacttgccgctaatgccatttgttccgctgtgcccgttaactgggtgccgacctctcggacaacctggagcatccatgcccaccatcagtggatgacgacagaagatatgctgtccgtctggaatagagtgtggattgaggaaaacccttggatggaggacaaaacccacgttagctcttgggaagacgtgccctacctcggcaagcgcgaggatcaatggtgcgggtccctgatcggacttaccgctcgggccacatgggcgaccaatattcaggtcgccatcaaccaggtgagacgcctgatcggcaatgagaactatctcgactacatgacaagcatgaagagattcaaaaatgaatctgatcccgagggggctctgtggtga

SEQ ID NO: 18487 - RNA, 9879 nt, synthetic construct
  misc_feature 1..9879: note = derived and/or modified CDS sequence (opt5) from DENV-1__KX380800__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcattacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcgatctttttcctgctcatcatgggacagctgacctggaatgacctgattagactttgcatcatggtgggcgctaacgtctccgatcggatgggcatggggacaacgtatctggccctcatggccacctttaagatgcgccctatgttcgctgtgggactgctctttagacggctgacatctcgcgaggtgcttctgctcaccattggcctgagcctggtcgcctccgttgaacttcccaactctctggaggaactcggggacggactggcgatgggcatcatgatgctcaaactgcttacagatttccaaagccaccagctgtggaccacgctcctgtccctgacatttatcaagaccacccttagcctggactacgcttggaaaacaatggccatggtgctctctattgtgtccctgttccccctctgtctgagcaccacatctcagaagacgacctggcttcctgtcctgctggggtcctttggatgcaaaccgctcacaatgttcctgatcaccgagaataagatttggggcagaaagagctggccccttaacgaaggcatcatggccgtggggattgtttctatcctgctctccagcctgctcaaaaatgatgtgcctctggctggaccccttatcgccggcgggatgctgattgcttgttatgtcatctccggaagctctgccgacctgagcctcgagcgggcggccgaggtgtcctgggaagaggaagctgagcattctggcgccagccacaacattctggttgaagtgcaggatgacgggacaatgaagatcaaagatgaggagcgcgacgatacccttacgattctgctcaaggctaccctgctcgccgtctccggagtgtaccctatgtctatccccgccacactgtttgtctggtatttctggcagaagaagaaacagagaagcggcgtgctttgggacacccctagccctcccgaagttgagcgggctgtgctggatgacggcatctaccgcattctgcagagagggctcctgggacggtctcaggtcggcgtgggggttttccaagacggagtgtttcatacaatgtggcacgtcaccagaggcgcggtgcttatgtatcaggggaaacgcctggaacccagctgggcctccgtgaagaaagatctcatcagctacggaggcggctggcggttccaggggtcttggaatacaggagaggaggttcaggtcattgctgtggaacccggcaagaaccctaaaaatgtgcaaacgacccccgggacatttaagaccccggagggagaagtcggcgccatcgccctggacttcaaacctgggacctccggaagccccattgtgaacagagagggcaagatcgttggcctctacgggaatggagtggtcacaacgtctggcacctatgtgtccgctattgcccaggcgaaggctagccaggaagggcctctgcccgagatcgaggatgaagtttttaaaaagcgcaaccttacaatcatggacctgcaccccggatccggcaaaacccggagatacctgcctgccattgtgcgcgaggccatcaagcggaaactcagaacactgattcttgctccgacccgcgtcgtggcctctgaaatggcggaggctctgaaggggatgcccatccggtatcaaacgacagccgttaagagcgaacataccggcaaagagattgtggatctcatgtgccacgccaccttcacaatgagactgctgtcccctgtccgggtgcccaattacaacatgatcatcatggacgaggctcattttaccgatcctgccagcattgctgcccgcggatatatctctacaagagtgggcatgggggaagcggccgctattttcatgaccgccacgccccctggatccgtcgaggcttttccgcagagcaatgccgttatccaggacgaagaacgggatattcccgaacgctcttggaacagcggctacgactggatcacagatttccctgggaagaccgtgtggtttgtgccctccatcaaatctggaaatgacattgccaactgtctcagaaagaacggcaaacgggtcatccagcttagcagaaagacattcgacaccgagtatcaaaagacgaaaaataacgattgggactacgtggttaccacagatatttccgagatgggggctaatttccgcgcggaccgggtgatcgatcctagacgctgcctgaagcccgtcattctgaaagacggcccggaacgggtgatcctcgccggacctatgcccgttaccgctgcctctgccgctcagagacgcggccggattgggagaaaccagaataaggagggagatcagtacatctatatgggccaacccctgaacaatgacgaagatcacgcccattggacagaggcgaaaatgcttctggacaacatcaatacccctgaggggattatccccgctctctttgaacctgagcgcgaaaagagcgccgccattgatggagagtacagactgcggggcgaagctcgcaagacattcgtggagctgatgagaagaggggacctcccggtctggctttcctataaagtggccagcgagggctttcagtactctgatcgcagatggtgcttcgacggagaacggaacaatcaggtcctggaggaaaacatggacgtggagatctggaccaaggaaggcgagcgcaagaagctgcgcccccggtggctcgatgcgagaacgtattccgaccctctggcccttcgcgagtttaaagagttcgctgccgggcggagaagcgtttccggagatctgattctcgagatcggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcattgccgtgctgacaggcggcgtcaccctgtttttcctcagcgggaagggacttggcaagacatccatcgggctgctgtgtgttatggcttctagcgtgctcctgtggatggcctccgtggagccccactggattgctgccagcatcattcttgaatttttcctgatggtcctcctgatcccggagcctgacagacagcggacgccccaggataaccaactggcctatgtggttatcggactcctttttatgattctgaccgtggctgcgaacgaaatgggcctgctcgagacaaccaaaaaggacctggggatcggacatgtcgtggccgagaatcaccaccatgctacaatgcttgatattgacctgcaccctgcctctgcctggaccctctacgctgtcgccacgaccatcattacacccatgatgcgccataccatcgaaaacacaaccgcgaatatttccctgacggccatcgctaaccaggccgctatcctgatgggcctcgataaaggctggcctattagcaagatggacatcggggtgccccttctggccctgggatgctactctcaggttaatccgctcacactgaccgcggccgtgcttatgctggtcgctcactatgccattatcggccctgggctccaagctaaagccacaagagaggctcagaagcggaccgccgcgggaattatgaagaaccccaccgtggatggcatcgttgccatcgacctggaccccgtggtctacgatgctaaattcgaaaagcagctggggcagattatgctccttatcctgtgtacatcccaaattctgctcatgcgcacgacctgggccctgtgcgagagcatcacacttgctaccggacctctgacaaccctctgggaaggctctccgggcaaattttggaatacgacaattgccgtgagcatggccaacatcttcagagggtcctatctggcgggagctggcctggccttctctctcatgaagtcccttgggggaggccggcgcgggaccggagctcagggcgagaccctgggcgagaaatggaagagacagctgaatcagctctccaagagcgaatttaacacatacaaacggtccgggatcatggaggtggacagatctgaagccaaggagggactgaaacgcggcgaaaccacaaagcatgccgttagccgggggacggctaaacttagatggttcgtcgagcgcaatctggtgaagcccgagggaaaggtgattgatctcggctgtgggcggggaggctggtcctattactgcgccggcctgaaaaaggtcaccgaagttaaagggtatacaaagggaggccctgggcacgaggaacccatccctatggcgacctacggatggaacattgtgaaactgcactctggcagagacgtgtttttcacaccccctgagaagtgtgataccctcctttgcgacatcggggaaagctccccgaatcccacgattgaggagggacgcaccctgcgggtcctgaaaatggtggaaccttggctcagaggcaaccaattttgtatcaagattctgaatccctacatgccttctgttgtggagacacttgaacagatgcagcgcaagcatggcgggatgctggtccggaaccccctcagcagaaattccacccacgagatgtattgggtgagctgcggaacaggcaacatcgtttctgccgtgaacatgacctcccgcatgctgctgaatcggttcacaatggctcatagaaaaccgacctacgagcgcgatgtcgacctcggggccggaacgagacacgtggctgtggaacctgagatcgccaacctggatattatcggccagcggattgaaaatatcaagaacgagcacaaaagcacatggcattatgacgaagataatccctacaagacctgggcgtatcacgggtcttacgaggtcaaaccctccggaagcgcctcttccatggttaacggcgtggtgcgccttctgaccaagccttgggacgtcattcccatggtgacacaaatcgctatgacggacaccacaccttttggccagcagagagttttcaaggagaaagtggatacccggacaccgagacccaagcgggggaccgcccaaatcatggaagtcacagctaaatggctctggggatttctgagccgcaataagaaacctagaatttgtacccgggaggagttcacgcgcaaggtgagatccaacgccgctatcggcgccgtttttgtggacgagaatcagtggaacagcgcgaaggaagccgtcgaggatgagcggttctgggaccttgtgcatcgcgaaagagagctgcacaaacaggggaagtgcgctacctgcgtttataatatgatgggaaaacgggaaaagaaactcggcgagtttgggaaggccaagggctctcgcgctatttggtacatgtggctgggagccagattcctggagttcgaggccctcggctttatgaacgaggatcattggttcagccgggaaaattccctgtctggggtggagggagaaggccttcacaaactggggtacatcctccgcgacattagcaagatccccggaggcaacatgtatgcggatgacacagctgggtgggataccagaatcacagaggacgatctgcagaatgaggccaaaattaccgacatcatggaacctgagcacgcccttctggctacgtccatttttaagctcacataccaaaacaaagtcgtgcgggtccagcgccccgccaagtctggcaccgtgatggatgttatcagcagacgggaccagagaggatccggccaggtggggacatatggactgaacaccttcacgaatatggaagtccaactgattcgccagatggagtctgaaggcatctttagcccgtccgagctcgagaacagcaatctggctgaacgggtgcttgactggctggagaaacatggggtggaaagactcaagcgcatggccatctctggagatgactgtgttgtgaagcctaccgatgaccggttcgcgacagccctgaccgctcttaacgatatgggcaaagtcagaaaggacattccccagtgggagccttccaaagggtggaatgattggcagcaagtgcccttttgcagccaccatttccaccagctgatcatgaaggacggccgcgaaattgttgtgccttgtcggaaccaggatgagctcgtcggacgggcccgcgtgtctcagggcgctgggtggtccctgcgggagacagcctgcctgggaaaaagctacgcgcaaatgtggcagctcatgtattttcacagacgcgacctgcggcttgccgctaatgccatctgttccgctgtccccgtgaactgggttccgacctctagaacaacctggagcattcatgcccaccatcagtggatgacgacagaagatatgctgtccgtgtggaatcgggtctggatcgaggaaaacccttggatggaggacaagacccacgtgagctcttgggaagacgttccctacctcggcaagagagaggatcaatggtgcgggtccctgattggacttaccgctcgcgccacatgggcgaccaatatccaggtggccatcaaccaggtccggagactgattggcaatgagaactatctcgactacatgacaagcatgaaacgcttcaagaatgaatctgatcccgagggggctctgtggtga

SEQ ID NO: 18488 - RNA, 9879 nt, synthetic construct
  misc_feature 1..9879: note = derived and/or modified CDS sequence (opt5) from DENV-1__KX380802__SS-prME
  source 1..9879: mol_type = other RNA
agcgtgaccatgctgctcatgctgcttcccacagccctggctttccacctcacgacccggggaggggaacctcatatgatcgtgtccaagcaagaacggggaaaatctctgctttttaagacaagcgccggagttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggggaaactcaccctgaagggcgtgtcctatgtcatgtgtacgggatccttcaaactggagaaggaagtggccgagacacagcacggcaccgttcttgtgcaggtcaagtacgaggggaccgacgcgccgtgcaaaattcctatctctacacaagatgaaaagggagtgacccagaacggccggctcatcacagctaatcccattgtgacggacaaagagaagcctgttaacatcgaaaccgagccgcccttcggggagtcctatattgtcatcggagccggcgaaaaagccctgaagctgagctggtttaagaaagggtctagcattggcaagatgttcgaggctacagccagaggagctcgccggatggccatcctcggcgataccgcgtgggactttgggtccatcggaggcgtgttcacatctgtggggaaactggtccatcaggtgtttggaaccgcctacggcgttcttttcagcggggtgtcctggacgatgaagattggcatcggcattctgctcacctggctgggcctgaatagcagatctacatcccttagcatgacctgtatcgctgtcgggatggtgacactctacctgggagttatggtgcaggccgattctggctgcgtcattaactggaaagggcgcgaactgaagtgtggatccggcatctttgtgaccaacgaggttcacacatggaccgaacaatataagttccaggctgacagccctaaacggctctccgccgcgattgggaaggcctgggaggagggcgtgtgcggaatcagatctgctacgcgcctggaaaatatcatgtggaaacagattagcaacgagcttaatcatatcctgctcgaaaacgatatgaagtttacagtcgtggtgggcgacgccaatgggattctgacccagggcaagaaaatgatccggccgcaacccatggagcacaaatactcctggaagtcttggggcaaggctaaaattatcggggccgacacccagaacacaaccttcatcattgatggacctgacacgcccgaatgtcctgatgaccagagagcctggaatatctgggaggtcgaggattatggctttggcgttttcacaaccaacatttggctgaaacttcgcgacagctacacacagatgtgcgatcaccggctcatgtccgctgcgatcaaagacagcaaggccgtgcatgctgatatggggtattggattgaatctgagaaaaatgaaacctggaagctggccagagcctcctttatcgaggtgaagacatgtatctggccccgcagccacaccctgtggtctaacggagtcctcgaatccgagatgattatcccgaaaatttacggcgggcctatcagccaacataattatcggcccggatacttcacgcagaccgctggcccttggcacctggggaaacttgagctggacttcaacctctgcgaaggaacaaccgtggttgtggatgagcactgcggcaatagaggcccctctctgcggacaaccacggtcacagggaaaattatccatgaatggtgttgccgcagctgtaccctgcctccccttagatttcggggagaggacggctgctggtacgggatggagatcagaccggtgaaggaaaaagaggaaaacctcgttcgctccatggtgagcgccggatctggcgaggtcgattccttcagcctggggctgctctgtgtgtccattatgatcgaagaggttatgcggtctagatggagccgcaagatgctgatgacaggaacccttgcggtgtttttcctgctcattatgggccagctgacctggaatgacctgatcagactttgcattatggtcggcgctaacgtgtccgaccggatggggatgggaacaacgtatctggccctcatggccacctttaagatgcgccctatgttcgctgtgggcctgctctttagacggctgacatctcgcgaggtccttctgctcaccatcgggctgagcctggttgcctccgtggaacttcccaactctctggaggaactcggagatggcctggcgatggggattatgatgctcaaactgcttacagacttccaaagccaccagctgtggaccacgctcctgtccctgacatttatcaagaccacccttagcctggattacgcttggaaaacaatggccatggtgctctctatcgtctccctgttccccctctgtctgagcaccacatctcagaagacgacctggcttcctgtgctgctgggatcctttggctgcaaaccgctcacaatgttcctgattaccgagaataagatctggggcagaaagagctggccccttaacgaagggattatggccgttggaatcgtgtctattctgctctccagcctgctcaaaaatgacgtccctctggctggcccccttatcgccgggggaatgctgatcgcttgttatgtgatttccggcagctctgccgatctgagcctcgagcgggcggccgaggtttcctgggaagaggaagctgagcattctggggccagccacaacatcctggtggaagtccaggacgatggaacaatgaagattaaagacgaggagcgcgatgacacccttacgatcctgctcaaggctaccctgctcgccgtgtccggcgtctaccctatgtctattcccgccacactgtttgtgtggtatttctggcagaagaagaaacagagaagcggcgttctttgggatacccctagccctcccgaagtggagcgggctgtcctggacgatgggatctaccgcatcctgcagagaggactcctgggccggtctcaggtgggggttggagtgttccaagacggcgtctttcatacaatgtggcacgtgaccagaggggcggtgcttatgtatcagggaaagcgcctggaacccagctgggcctccgttaagaaagacctcattagctacggcggcgggtggcggttccagggatcttggaatacaggcgaggaggtccaggtgatcgctgtggaacccgggaagaaccctaaaaatgtccaaacgacccccggaacatttaagaccccggagggcgaagtgggggccattgccctggatttcaaacctggaacctccggcagccccatcgttaacagagagggcaagattgtggggctctacggaaatggcgtcgtgacaacgtctgggacctatgtttccgctatcgcccaggcgaaggctagccaggaaggacctctgcccgagattgaggacgaagtgtttaaaaagcgcaaccttacaatcatggatctgcaccccggctccgggaaaacccggagatacctgcctgccatcgtccgcgaggccattaagcggaaactcagaacactgatccttgctccgacccgcgtggttgcctctgaaatggcggaggctctgaagggcatgcccattcggtatcaaacgacagccgtcaagagcgaacataccggaaaagagatcgtcgacctcatgtgccacgccaccttcacaatgagactgctgtcccctgtgcgggtgcccaattacaacatgattatcatggatgaggctcattttaccgaccctgccagcatcgctgcccgcggctatatttctacaagagtcgggatgggagaagcggccgctatcttcatgaccgccacgccccctggctccgttgaggcttttccgcagagcaatgccgtgattcaggatgaagaacgggacatccccgaacgctcttggaacagcgggtacgattggattacagacttccctggaaagaccgtgtggtttgtcccctccatcaaatctggcaatgatatcgccaactgtctcagaaagaacgggaaacgggtgattcagcttagcagaaagacattcgacaccgagtatcaaaagacgaaaaataacgactgggattacgttgtgaccacagacatctccgagatgggcgctaatttccgcgcggatcgggtcattgaccctagacgctgcctgaagcccgtgatcctgaaagatggaccggaacgggttattctcgccggccctatgcccgtgaccgctgcctctgccgctcagagacgcgggcggatcggaagaaaccagaataaggagggcgaccagtacatttatatggggcaacccctgaacaatgatgaagaccacgcccattggacagaggcgaaaatgcttctggataacatcaatacccctgagggaatcattcccgctctctttgaacctgagcgcgaaaagagcgccgccatcgacggcgagtacagactgagaggggaagctcgcaagacattcgtcgagctgatgagacggggcgatctcccggtgtggctttcctataaagtcgccagcgagggatttcagtactctgaccgcagatggtgcttcgatggcgaacggaacaatcaggtgctggaggaaaacatggacgttgagatttggaccaaggaaggggagcgcaagaagctgcgcccccggtggctcgacgcgagaacgtattccgatcctctggcccttcgcgagtttaaagagttcgctgccggacggagaagcgtgtccggcgacctgatcctcgagattgggaagctgccccagcacctgacactccgggctcaaaatgcccttgataacctggtgatgctgcacaattctgaacagggaggcaaggcttaccgccatgccatggaggaactccctgacaccatcgagaccctgatgcttctggcgctcatcgccgtcctgacaggcggggttaccctgtttttcctcagcggaaagggccttgggaagacatccattggactgctgtgtgtgatggcttctagcgtgctcctgtggatggcctccgtcgagccccactggatcgctgccagcattatccttgaatttttcctgatggtgctcctgattccggagcctgatagacagcggacgccccaggacaaccaactggcctatgttgtgatcggcctcctttttatgatcctgaccgtcgctgcgaacgaaatggggctgctcgagacaaccaaaaaggatctgggaattggccatgtggtcgccgagaatcaccaccatgctacaatgcttgacatcgatctgcaccctgcctctgcctggaccctctacgctgtggccacgaccattatcacacccatgatgcgccataccattgaaaacacaaccgcgaatatctccctgacggccattgctaaccaggccgctatcctgatgggcctcgacaaagggtggcctatcagcaagatggatattggagttccccttctggccctgggctgctactctcaggtgaatccgctcacactgaccgcggccgtccttatgctggtggctcactatgccatcattgggcctggactccaagctaaagccacaagagaggctcagaagcggaccgccgcgggcatcatgaagaaccccaccgttgacgggattgtggccatcgatctggaccccgtcgtgtacgacgctaaattcgaaaagcagctgggacagatcatgctccttattctgtgtacatcccaaatcctgctcatgcgcacgacctgggccctgtgcgagagcattacacttgctaccggccctctgacaaccctctgggaaggctctccggggaaattttggaatacgacaatcgccgtgagcatggccaacattttcagaggatcctatctggcgggcgctgggctggccttctctctcatgaaaagccttggaggcgggcggcgcggaaccggcgctcagggcgagaccctgggggagaaatggaagagacagctgaatcagctctccaagagcgaatttaacacatacaaacggtccggaatcatggaggttgatagatctgaagccaaggagggcctgaaacgcggggaaaccacaaagcatgccgtcagccggggaacggctaaacttagatggttcgtggagcgcaatctggtgaagcccgagggcaaggtcatcgacctcgggtgtggacggggcggctggtcctattactgcgccgggctgaaaaaggttaccgaagtgaaaggatatacaaagggcgggcctggacacgaggaacccattcctatggcgacctacggctggaacatcgtgaaactgcactctgggagagatgtctttttcacaccccctgagaagtgtgacaccctcctttgcgatattggagaaagctccccgaatcccacgatcgaggagggccgcaccctgcgggtgctgaaaatggttgaaccttggctcagaggcaaccaattttgtattaagatcctgaatccctacatgccttctgtggtcgagacacttgaacagatgcagcgcaagcatgggggaatgctggtgcggaaccccctcagcagaaattccacccacgagatgtattgggttagctgcggcacagggaacattgtgtctgccgtcaacatgacctcccgcatgctgctgaatcggttcacaatggctcatagaaaaccgacctacgagcgcgacgtggatctcggagccggcacgagacacgtggctgtcgaacctgagatcgccaacctggacatcattgggcagcggatcgaaaatattaagaacgagcacaaaagcacatggcattatgatgaagacaatccctacaagacctgggcgtatcacggatcttacgaggttaaaccctccggcagcgcctcttccatggtgaacggcgtggtccgccttctgaccaagccttgggatgtgatccccatggttacacaaattgctatgacggacaccacaccttttgggcagcagagagtgttcaaggagaaagtcgacacccggacaccgagacccaagcggggaaccgcccaaatcatggaagtgacagctaaatggctctggggctttctgagccgcaataagaaacctagaatctgtacccgggaggagttcacgcgcaaggttagatccaacgccgctattggggccgtgtttgtcgatgagaatcagtggaacagcgcgaaggaagccgtggaggacgagcggttctgggatcttgttcatcgcgaaagagagctgcacaaacagggaaagtgcgctacctgcgtgtataatatgatgggcaaacgggaaaagaaactcggggagtttggcaaggccaagggatctcgcgctatctggtacatgtggctgggcgccagattcctggagttcgaggccctcgggtttatgaacgaggaccattggttcagccgggaaaattccctgtctggagtcgagggcgaagggcttcacaaactgggatacattctccgcgatatcagcaagattcccggcgggaacatgtatgcggacgatacagctggctgggacaccagaatcacagaggatgacctgcagaatgaggccaaaatcaccgatattatggaacctgagcacgcccttctggctacgtccatctttaagctcacataccaaaacaaagtggtccgggtgcagcgccccgccaagtctggaaccgttatggacgtgattagcagacgggatcagagaggctccgggcaggtcggaacatatggcctgaacaccttcacgaatatggaagtgcaactgatccgccagatggagtctgaagggatttttagcccgtccgagctcgagaacagcaatctggctgaacgggtgcttgactggctggagaaacatggagttgaaagactcaagcgcatggccatctctggcgacgattgtgtggtcaagcctaccgacgatcggttcgcgacagccctgaccgctcttaacgacatggggaaagtgagaaaggatatcccccagtgggagccttccaaaggctggaatgactggcagcaagttcccttttgcagccaccatttccaccagctgattatgaaggatggacgcgaaatcgtggtcccttgtcggaaccaggacgagctcgtgggcagagcccgcgtctctcagggggctggatggtccctgcgggagacagcctgcctgggcaaaagctacgcgcaaatgtggcagctcatgtattttcacagacgcgatctgcggcttgccgctaatgccatttgttccgctgtgcccgttaactgggtgccgacctctagaacaacctggagcatccatgcccaccatcagtggatgacgacagaagacatgctgtccgtctggaatcgggtgtggattgaggaaaacccttggatggaggataagacccacgttagctcttgggaagacgtgccctacctcgggaagagagaggaccaatggtgcggatccctgatcggccttaccgctcgcgccacatgggcgaccaatattcaggtcgccatcaaccaggtgcggagactgatcgggaatgagaactatctcgattacatgacaagcatgaaacgcttcaagaatgaatctgaccccgagggcgctctgtggtga

SEQ ID NO: 18489 - RNA, 9879 nt, synthetic construct
  misc_feature 1..9879: note = derived and/or modified CDS sequence (opt5) from DENV-1__KX380797__SS-prME
  source 1..9879: mol_type = other RNA
agcgtgaccgtgctgctcatgctgcttcccacagccctggctttccacctcacgacccggggcggggaacctcatatgatcgtttccaagcaggaacggggaaaatctctgctttttaagaccagcaccggcgtgaacatgtgcaccctgattgccatggacctcggggaactgtgtgaagataccatgacatacaaatgcccgcgcatcaccgagacggaacccgacgatgtggactgttggtgcaatgcgaccgagacatgggtcacctatggaacatgttcccaaaccggcgagcacagacgggataagcgctctgtggctctggcccctcatgttgggctcggactggaaacgagaacagagacctggatgagctccgaaggcgcctggcggcagattcagaaagtggagacatgggctcttagacaccccggcttcaccgtcatcgccctgtttctcgctcatgccattgggacctctatcacacagaagggaatcattttcatcctgcttatgctggtgacgcctagcatggcgatgagatgcgttggcattgggaaccgggactttgtggagggactctccggcgccacctgggtcgatgtggtgctggaacacgggagctgtgtcacaaccatggctaaggacaaacccacactggatatcgagctcctgaagaccgaagttacgaatcctgccgtgcttcgcaaactgtgcattgaggctaagatctctaacacaaccaccgactccagatgtccgacacaaggagaagccaccctcgtggaggagcaggatacaaatttcgtctgccggcgcacgctggtggacagaggctggggcaacgggtgtggactttttggcaaagggagcctgattacctgcgcgaagttcaagtgcgttacaaaactcgaaggaaagatcgtgcagtacgagaatctgaaatattctgtcatcgtgaccgttcacacaggcgatcagcatcaagtggggaacgaaaccacggagcacggaaccacagccaccattacaccccaggctcctacctccgaaatccagctgacggactacggcgccctcacactggactgtagcccccggaccggccttgattttaatgagatggtcctgctcacaatgaaggagaaatcttggctggtgcataagcagtggttccttgacctgcctctcccctggacctccggggctagcacctcccaagaaacatggaaccgccaggatctgctggtcacgtttaaaaccgcccacgccaagaagcaggaggtggttgtgctcggatctcaagaaggcgctatgcacacagcgctgaccggggccacagagattcagaccagcggaacgacaaccatcttcgctggccatcttaaatgcagactgaagatggacaaactcaccctgaagggggtctcctatgtgatgtgtacaggcagctttaaactggaaaaggaggttgccgagacccagcacggaacagtgcttgtccaggtgaagtacgaaggcacggatgccccgtgcaaaattcctttcacctctcaagacgagaagggggtgacacagaatggacggctcatcaccgctaaccccatcgttacagataaagaaaagcctgtcaatattgaggccgagccgcccttcggcgaatcctatctggtggtgggggcgggagagaaagctctgaagctcagctggtttaagaaaggctctagcatcgggaagatgttcgaagccaccgccagaggcgctcgccggatggccattctgggagacacggcttgggattttggctccatcgggggagtcttcacctctgtgggcaaacttattcatcagatctttgggacagcctacggagttctgttcagcggcgtgtcctggaccatgaagatcgggattggcatcctcctgacatggctgggacttaacagcagatctacctccctcagcatgacatgtattgcggtcggcatggtgaccctgtacctgggggttatggtgcaggccgactctggatgcgtcatcaattggaaaggccgcgagctcaagtgtgggtccggaatttttgtgacgaacgaagttcacacatggaccgagcaatataagttccaggctgatagccctaaacggctgtccgccgctatcggcaaggcctgggaggaaggggtgtgcggcattagatctgcgacccgccttgagaacatcatgtggaaacagatcagcaatgaactgaaccatattctcctggagaatgacatgaagtttacagtcgtggtgggagacgtcaacggcatcctggcccaggggaaaaagatgattcggccgcaacccatggaacacaaatactcctggaagtcttggggaaaggctaaagttatcggcgccgatgtgcagaatagcaccttcattatcgacgggcctaacacgcccgagtgtcctgatgaccagagagcttggaatatctgggaggtggaagattatggatttggcattttcacaaccaacatctggcttaagctccgcgactcctacacacaggtctgcgatcaccggctgatgagcgccgccattaaagactctaaggctgtgcatgcggatatgggctattggatcgagtccgagaagaatgagacctggaagctgacaagagccagctttattgaagttaagacctgtgtgtggcccaaatctcacacgctctggtccaacggggtcctggagagcgagatgatcatcccgaagatttacggaggccctatctctcaacataattatcgccccgggtacttcacccagacagctggaccttggcaccttggcaaactggaactcgacttcgggctgtgcgagggaaccacagtggttgtggatgaacactgcggcaaccggggccccagcctgagaaccacgacagtcaccgggaagattatccatgagtggtgttgccggtcctgtacacttcctcccctccgctttaaaggagaggacggctgctggtacgggatggaaattagaccggtgaaggagaaggaagagaatctggttaaaagcatggtgtctgccggatccggcgaagtcgatagcttctccctggggctcctgtgtatctctatcatgattgaggaggtgatgcggagcagatggtcccgcaagatgcttatgaccggaaccctggccgtgtttctcctgctgatcatgggccagcttacatggaacgacctgattcggctctgcatcatggtcggcgctaatgcctctgacaaaatggggatgggaacgacctatctggcgctcatggctacattcagaatgcgccctatgtttgccgttggcctgcttttcagacggctgaccagccgcgaagtgctcctgagatccgtggggctgtctcttgtcgccagcgtggagctgcccaactccctcgaagaactgggagatggcctcgctatggggattatgatgctgaaacttctgacagactttcaaagccaccagctctgggccgcgctgctgtctcttaccttcgttaaaacgacattttccctgcattacgcttggaagaccatggccatgatcctcagcattgtgtctctgttccccctctgtctgtccaccacaagccagaagaccacatggcttcctgtcctgctgggatctctcggctgcaaaccgctgacgatgtttcttatcaccgaaaacaagatctggggccggaaatcctggcccctgaatgaggggattatggccgtgggaatcgttagcattctcctgtccagcctcctgaagaacgatgtgcctcttgctggccccctgatcgccgggggaatgctgattgcttgttatgtcatctctggcagctccgccgacctctctctggagaaagcggccgaagtgagctgggaggaagaggctgaacactccggggcctctcataatatccttgtcgaggtgcaggatgacggaacaatgaagattaaagatgaggaacgcgacgataccctgacaatcctcctgaaggctaccctcctggccattagcggcgtttaccctatgtccatccccgccacgcttttcgtgtggtatttttggcaaaagaaaaagcagagatctggcgtcctgtgggacacccctagccctcccgaggtggaacgggctgttctggatgacgggatttaccgcatcctccagagaggactgcttggcaaatcccaggtgggggtcggagtgttccaagagggcgtgttccacacaatgtggcacgttaccagaggggcggtcctgatgtatcagggaaagcgcctcgagcccagctgggcctctgtgaaaaaggatctgatctcctacggcggcgggtggagatttcagggaagctggaacacaggcgaagaggtgcaggtcattgctgtggaacccgggaagaatcctaaaaacgttcaaaccgcccccggaacattcaagacgccggagggcgaagtgggggccatcgctctcgactttaaacctggaacctctggctcccccattgtcaatcgggagggcaagatcgtggggctgtacggaaacggcgttgtgacaaccagcgggacctatgtctccgccattgcgcaggctaaagcctctcaggagggacctcttcccgaaatcgaggacgaagtgttcagaaagcgcaatctgacaattatggatctgcatcccggcagcgggaagacgcggagatacctccctgccatcgttcgcgaggctatcaaacggaagctgagaacccttgtgctggccccgacacgcgtcgtggcgtccgaaatggctgaggccctcaaaggcatgcccattcggtatcaaaccacagccgtcaagagcgagcacaccggaaaagaaatcgtcgacctgatgtgccatgctacgtttacaatgagactgctctctcctgttcgcgtgcccaactacaatatgattatcatggatgaggcccacttcaccgaccctgcttccattgccgcgcggggctatatcagcaccagagtggggatgggagaagccgctgccatctttatgacagctacaccccctggctctatggaggccttcccgcagagcaacgccgctattcaggatgaagaacgggacatccccgagcgctcctggaactctgggtacgattggattacagactttcctggaaagaccgtctggttcgtgcccagcatcaagtccggcaacgatattgcgaattgtcttcgcaaaaatgggaagcgggttgtgcagctgtctcgcaaaacgtttgacacagaatatcaaaagaccaaaaacaatgattgggactacgtcgtgacaaccgacatcagcgagatgggcgccaacttcagagctgatcgggttatcgaccctagacgctgcctgaagcccgtgattctcaaggatggaccggaacgggtcatcctggccggccctatgcccgtgacggtcgcctccgctgcccagagacgcgggcggattggaagaaatcagaacaaagagggcgaccagtacatctatatggggcaaccccttaataacgatgaggaccatgcgcactggaccgaagctaagatgctgctcgataatattaacacacctgagggaatcattcccgccctgttcgaacctgagcgcgagaaaagcgccgctatcgacggcgagtaccggctgagaggggaggcccgcaagacctttgtggaactcatgagacggggcgatcttccggtttggctgtcttataaagtggcgtccgagggattccagtacagcgaccgcagatggtgctttgatggcgaacggaataaccaggtgctggaggaaaatatggacgtcgagatctggacaaaggagggggaacgcaaaaagctcagaccccggtggctggatgccagaacctattccgaccctcttgctctgcgcgagttcaaggaatttgccgctggacggagatctgttagcggcgacctcattctggagatcgggaaactgccccagcacctcacacaacgcgcccagaacgctcttgataatctggtgatgctgcataactccgaacagggaggcaaggcctaccggcacgcgatggaggagctccctgacaccattgaaacgctgatgcttctggccctcatcgctgtgctgacaggcggggtcaccctgttctttctctctggaagaggccttgggaaaaccagcattggactgctgtgtgtgatggcctccagcgctctcctgtggatggcctctgttgagccccattggatcgccgcttccatcattcttgagttctttctgatggtgctcctgatcccggagcctgatcggcagcgcacaccccaagacaatcagctggcgtatgtcgtgattggcctccttttcatgatcctgaccgtcgccgctaacgagatggggctgctcgaaacaacgaagaaagatctgggaattggccacgtggccgccgagagccaccatcacgctgccatgcttgacgttgatctgcatcctgcgtctgcctggaccctctacgctgtggccacaaccatcatcacacccatgatgagacacaccattgaaaacacgaccgctaatatctccctgacagccattgcgaaccaggccgctatcctgatgggcctcgacaaggggtggcctattagcaagatggatatcggagtcccccttctggccctgggctgctactctcaagtgaatccgctcaccctgacagctgccgttcttatgctggtggctcattatgccattatcgggcctggactccaggcgaaagccacccgggaggctcagaagcgcacggccgctggcatcatgaaaaaccccacagtcgacgggattgtggccatcgatctggaccccgtggtttacgatgccaagtttgaaaaacagctgggacaaattatgctccttatcctgtgtaccagccagattctgctcatgagaacaacctgggcgctgtgcgagtccatcacccttgctacaggccctctgacgaccctctgggagggctctccggggaagttctggaatacaaccatcgccgtcagcatggctaacatttttcggggatcctatctggccggcgccgggctggctttcagcctcatgaagtcccttggaggcgggcgcagaggaacaggcgcccagggcgaaaccctgggggagaaatggaagcggcagctgaatcaactcacgaaatctgagttcaacacatacaagcgcagcggaatcattgaggtggacagatccgaagcgaaagagggcctgaagagaggggaaaccaccaagcacgccgtgtctcggggaacagctaaacttcgctggtttgtcgaacggaatctggttaagcccgagggcaaagtgatcgacctcgggtgtggaagaggcggctggagctattactgcgccgggctgaagaaagtgaccgaagtcaagggatatacaaaaggcgggcctggacacgaggaacccattcctatggctacgtacggctggaacctggtgaagctctactccgggaaggatgttttctttacaccccctgagaaatgtgacacacttctgtgcgatatcggagagtctagcccgaatcccaccatcgaagagggccgcacactgcgggtgctcaagatggtcgaaccttggctgagaggcaaccagttctgtattaaagtgcttaatccctatatgccttccgttgtggagaccctggagcagatgcagcgcaagcatgggggaatgctcgtccggaaccccctgagcagaaattctacgcacgaaatgtactgggtgtcctgcggcaccgggaacatcgtgagcgccgtcaatatgacatctcgcatgctgctcaaccggtttaccatggcgcatagaaaaccgacatatgagcgcgacgttgatctgggagccggcacccggcacgtggctgtggaacctgaggtcgccaaccttgacattatcgggcaaagaattgaaaatatcaagaacgagcacaagtccacatggcattacgatgaggacaatccctataaaacctgggcttaccacggaagctatgaagtgaagccctctggctccgccagctccatggttaacggcgtggtccgcctgctcacgaaaccttgggatgtgattcccatggttacacagatcgctatgaccgacaccacacctttcgggcagcaaagagtgtttaaggagaaagtcgatacgcggaccccgaaggccaagcgcggaacagcgcagatcatggaagtgaccgccagatggctgtggggcttccttagccggaataaaaagcccagaatttgtacacgggaggaatttacccgcaaagttagatctaacgctgccatcggggctgtgttcgtcgacgagaatcagtggaacagcgccaaggaggccgtggaagacgagcggttttgggatctggtccatcgcgaaagagagctccacaaacagggaaagtgcgcgacatgcgtgtacaatatgatgggcaagcgggagaaaaagctgggggagttcggcaaagctaagggatcccgcgccatttggtacatgtggctgggcgccagatttctcgagttcgaagctctggggttcatgaacgaggaccattggttttctcgggaaaatagcctttccggagttgagggcgaggggctgcacaaactcggatatatcctgcgcgatatttctaagatccctggcgggaacatgtacgccgacgataccgctggctgggacacgagaatcaccgaagatgaccttcaaaatgaggccaaaattacagatatcatggaacccgagcacgcgctgctcgccaccagcattttcaagctgacatatcagaacaaggtggtccgggtgcagcgccctgctaaaaatggaaccgtgatggacgttatctccagacgggatcagcgcggctctgggcaagtgggaacgtacggcctgaacacatttaccaacatggaagcccagctcattagacagatggagagcgaggggatcttcctgccctccgaacttgagacaccgaatctggctgaacgggtcctcgactggctggagaagtatggaatcgaaagacttaaacgcatggccattagcggcgatgactgtgtggttaagcctgtggacgatcggtttgcgaccgccctgacggctctcaacgacatggggaaagtcagaaaggatatcccccagtgggagccttctaagggctggaatgactggcaacaggtgcccttctgctcccatcactttcatcagctgattatgaaagatggacgcgagatcgtcgtgccttgtcggaaccaggacgaactggttggcagagcccgcgtgagccaaggggctggatggtctctccgggagaccgcctgcctgggcaagtcctacgctcagatgtggcagcttatgtatttccacagacgcgatctgcggctcgccgcgaatgccatttgtagcgctgtccccgtggactgggttccgacatccagaaccacatggtctatccacgcccatcaccaatggatgaccacagaagatatgctgagcgtgtggaaccgcgtctggatcgaggaaaatccttggatggaggacaaaacccatgtgtccagctgggaggatgtgccctaccttgggaagcgggaagaccagtggtgcggatctctgattggcctcacggccagagctacatgggccaccaacatccaggttgcgattaatcaggtccggagactgatcgggaacgagaattacctggactatatgacctccatgaaacgctttaagaacgaaagcgatcccgagggcgctctctggtga

SEQ ID NO: 18490 - RNA, 9879 nt, synthetic construct
  misc_feature 1..9879: note = derived and/or modified CDS sequence (opt5) from DENV-1__KX380805__SS-prME
  source 1..9879: mol_type = other RNA
agcgtgaccatgctgctcatgctgcttcccacagccctggctttccacctcacgacccggggcggggagcctcatatgattgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctccgtgtctattatgatcgaagaggttatgcggagcagatggtcccgcaagatgctgatgacagggacccttgcggtgtttttcctgctcattatgggacagctgacctggaatgacctgatcagactttgtattatggtcggcgctaacgtgtctgatcggatgggcatggggacaacgtatctggccctcatggccacctttaagatgcgccctatgttcgctgtgggactgctctttagacggctgacaagccgcgaggtccttctgctcaccatcggcctgtccctggttgcctctgtggaacttcccaacagcctggaggaactcggggacggactggcgatgggcattatgatgctcaaactgcttacagatttccaatcccaccagctgtggaccacgctcctgagcctgacatttatcaagaccaccctttctctggactacgcttggaaaacaatggccatggtgctctccatcgtcagcctgttccccctctgcctgtctaccacatcccagaagacgacctggcttcctgtgctgctggggagctttggatgtaaaccgctcacaatgttcctgattaccgagaataagatctggggcagaaagtcttggccccttaacgaaggcattatggccgttgggatcgtgtccattctgctcagctccctgctcaaaaatgatgtccctctggctggaccccttatcgccggcgggatgctgatcgcttgctatgtgattagcggatctagcgccgacctgtccctcgagcgggcggccgaggtttcttgggaagaggaagctgagcatagcggcgcctcccacaacatcctggtggaagtccaggatgacgggacaatgaagattaaagatgaggagcgcgacgatacccttacgatcctgctcaaggctaccctgctcgccgtgtctggagtctaccctatgagcattcccgccacactgtttgtgtggtatttctggcagaagaagaaacagagatccggcgttctttgggacaccccttctcccccggaagtggagcgggctgtcctggatgacggcatctaccgcatcctgcagagagggctcctgggacggagccaggtgggcgttggggtgttccaagacggagtctttcatacaatgtggcacgtgaccagaggcgcggtgcttatgtatcaggggaaacgcctggaaccttcctgggccagcgttaagaaagatctcatttcttacggaggcggctggcggttccaggggtcctggaatacaggagaggaggtccaggtgatcgctgtggaacccggcaagaaccctaaaaatgtccaaacgacccccgggacatttaagaccccggagggagaagtgggcgccattgccctggacttcaaacctgggaccagcggatctcccatcgttaacagagagggcaagattgtgggcctctacgggaatggagtcgtgacaacgtccggcacctatgttagcgctatcgcccaggcgaaggcttcccaggaagggcctctgcccgagattgaggatgaagtgtttaaaaagcgcaaccttacaatcatggacctgcaccccggatctggcaaaacccggagatacctgcctgccatcgtccgcgaggccattaagcggaaactcagaacactgatccttgctccgacccgcgtggttgccagcgaaatggcggaggctctgaaggggatgcccattcggtatcaaacgacagccgtgaagtccgaacataccggcaaagagatcgtcgatctcatgtgtcacgccaccttcacaatgagactgctgagccctgtgcgggtgcccaattacaacatgattatcatggacgaggctcattttaccgatcctgcctctatcgctgcccgcggatatatttccacaagagtcggcatgggggaagcggccgctatcttcatgaccgccacgccccctggaagcgttgaggcttttccgcagtctaatgccgtgattcaggacgaagaacgggatatccccgaacgcagctggaactccggctacgactggattacagatttccctgggaagaccgtgtggtttgtcccctctatcaaaagcggaaatgacatcgccaactgcctcagaaagaacggcaaacgggtgattcagctttccagaaagacattcgacaccgagtatcaaaagacgaaaaataacgattgggactacgttgtgaccacagatatctctgagatgggggctaatttccgcgcggaccgggtcattgatcctagacgctgtctgaagcccgtgatcctgaaagacggcccggaacgggttattctcgccggacctatgcccgtgaccgctgccagcgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagtccgccgccatcgatggagagtacagactgcggggcgaagctcgcaagacattcgtcgagctgatgagaagaggggacctcccggtgtggcttagctataaagtcgcctctgagggctttcagtactccgatcgcagatggtgcttcgacggagaacggaacaatcaggtgctggaggaaaacatggacgttgagatttggaccaaggaaggcgagcgcaagaagctgcgcccccggtggctcgatgcgagaacgtatagcgaccctctggcccttcgcgagtttaaagagttcgctgccgggcggagatccgtgtctggagatctgatcctcgagattggcaagctgccccagcacctgacactccgggctcaaaatgcccttgacaacctggtgatgctgcacaatagcgaacaagggggaaaggcttaccgccatgccatggaggaactccctgataccatcgagaccctgatgcttctggcgctcatcgccgtcctgacaggcggcgttaccctgtttttcctctccgggaagggacttggcaagacatctattgggctgctgtgcgtgatggctagctccgtgctcctgtggatggccagcgtcgagccccactggatcgctgcctctattatccttgaatttttcctgatggtgctcctgattccggagcctgacagacagcggacgccccaggataaccaactggcctatgttgtgatcggactcctttttatgatcctgaccgtcgctgcgaacgaaatgggcctgctcgagacaaccaaaaaggacctggggattggacatgtggtcgccgagaatcaccaccatgctacaatgcttgatatcgacctgcaccctgcctccgcctggaccctctacgctgtggccacgaccattatcacacccatgatgcgccataccattgaaaacacaaccgcgaatatcagcctgacggccattgctaaccaggccgctatcctgatgggcctcgataaaggctggcctatctctaagatggacattggggttccccttctggccctgggatgttactcccaggtgaatccgctcacactgaccgcggccgtccttatgctggtggctcactatgccatcattggccctgggctccaagctaaagccacaagagaggctcagaagcggaccgccgcgggaatcatgaagaaccccaccgttgatggcattgtggccatcgacctggaccccgtcgtgtacgatgctaaattcgaaaagcagctggggcagatcatgctccttattctgtgcacaagccaaatcctgctcatgcgcacgacctgggccctgtgtgagtctattacacttgctaccggacctctgacaaccctctgggaaggcagcccgggcaaattttggaatacgacaatcgccgtgtccatggccaacattttcagagggtcttatctggcgggagctggcctggccttcagcctcatgaagtcccttgggggaggccggcgcgggaccggagctcagggcgagaccctgggcgagaaatggaagagacagctgaatcagctcagcaagtccgaatttaacacatacaaacggtctgggatcatggaggttgacagaagcgaagccaaggagggactgaaacgcggcgaaaccacaaagcatgccgtctcccgggggacggctaaacttagatggttcgtggagcgcaatctggtgaagcccgagggaaaggtcatcgatctcggctgcgggcggggaggctggtcttattactgtgccggcctgaaaaaggttaccgaagtgaaagggtatacaaagggaggccctgggcacgaggaacccattcctatggcgacctacggatggaacatcgtgaaactgcacagcggcagagacgtctttttcacaccccctgagaagtgcgataccctcctttgtgacattggggaatcctctccgaatcccacgatcgaggagggacgcaccctgcgggtgctgaaaatggttgaaccttggctcagaggcaaccaattttgcattaagatcctgaatccctacatgcctagcgtggtcgagacacttgaacagatgcagcgcaagcatggcgggatgctggtgcggaaccccctctccagaaatagcacccacgagatgtattgggtttcttgtggaacaggcaacattgtgtccgccgtcaacatgaccagccgcatgctgctgaatcggttcacaatggctcatagaaaaccgacctacgagcgcgatgtggacctcggggccggaacgagacacgtggctgtcgaacctgagatcgccaacctggatatcattggccagcggatcgaaaatattaagaacgagcacaaatctacatggcattatgacgaagataatccctacaagacctgggcgtatcacgggtcctacgaggttaaacccagcggatctgcctccagcatggtgaacggcgtggtccgccttctgaccaagccttgggacgtgatccccatggttacacaaattgctatgacggacaccacaccttttggccagcagagagtgttcaaggagaaagtcgatacccggacaccgagacccaagcgggggaccgcccaaatcatggaagtgacagctaaatggctctggggatttctgtcccgcaataagaaacctagaatctgcacccgggaggagttcacgcgcaaggttagaagcaacgccgctattggcgccgtgtttgtcgacgagaatcagtggaactctgcgaaggaagccgtggaggatgagcggttctgggaccttgttcatcgcgaaagagagctgcacaaacaggggaagtgtgctacctgcgtgtataatatgatgggaaaacgggaaaagaaactcggcgagtttgggaaggccaagggcagccgcgctatctggtacatgtggctgggagccagattcctggagttcgaggccctcggctttatgaacgaggatcattggttctcccgggaaaattctctgagcggggtcgagggagaaggccttcacaaactggggtacattctccgcgacatctccaagattcccggaggcaacatgtatgcggatgacacagctgggtgggataccagaatcacagaggacgatctgcagaatgaggccaaaatcaccgacattatggaacctgagcacgcccttctggctacgtctatctttaagctcacataccaaaacaaagtggtccgggtgcagcgccccgccaagagcggcaccgttatggatgtgatttccagacgggaccagagaggatctggccaggtcgggacatatggactgaacaccttcacgaatatggaagtgcaactgatccgccagatggagagcgaaggcatcttttccccgagcgagctcgagaactctaatctggctgaacgggtgcttgactggctggagaaacatggggttgaaagactcaagcgcatggccatctccggagatgactgcgtggtcaagcctaccgatgaccggttcgcgacagccctgaccgctcttaacgatatgggcaaagtgagaaaggacatcccccagtgggagcctagcaaagggtggaatgattggcagcaagttcccttttgttctcaccatttccaccagctgattatgaaggacggccgcgaaatcgtggtcccttgccggaaccaggatgagctcgtgggacgggcccgcgtctcccagggcgctgggtggagcctgcgggagacagcctgtctgggaaaatcctacgcgcaaatgtggcagctcatgtattttcacagacgcgacctgcggcttgccgctaatgccatttgctctgctgtgcccgttaactgggtgccgaccagcagaacaacctggtccatccatgcccaccatcagtggatgacgacagaagatatgctgagcgtctggaatcgggtgtggattgaggaaaacccttggatggaggacaagacccacgtttcttcctgggaagacgtgccctacctcggcaagagagaggatcaatggtgtgggagcctgatcggacttaccgctcgcgccacatgggcgaccaatattcaggtcgccatcaaccaggtgcggagactgatcggcaatgagaactatctcgactacatgacatctatgaaacgcttcaagaatgaaagcgatcccgagggggctctgtggtga

SEQ ID NO: 18491 - RNA, 9879 nt, synthetic construct
  misc_feature 1..9879: note = derived and/or modified CDS sequence (opt5) from DENV-1__KX380798__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgagaccacgaaacacgctgtttctagagggacagccaaacttcgctggtttgtcgagcggaatctggtgaaacccgaaggaaaggtgattgatctcggctgtgggagaggaggctggagctactattgcgctggcctgaagaaagtcaccgaggttaaggggtacaccaaaggaggccctgggcacgaagaacccatccctatggccacatacggatggaacctggtgaagctccattccggcaaagacgtgttctttattccccctgaaaagtgtgatacccttctgtgcgacatcggggagtctagcccgaatcccacaattgaggaaggacgcacgctgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgcggtgaatatgacatctcgcatgctgctcaaccggtttaccatggcccacagaaaaccgacgtatgaacgcgatgtcgacctgggggctggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagcgcgtgtttaaagaaaaggtcgacacaagaaccccgaaagcgaagcgggggaccgcccaaattatggaggtgacagctaaatggctgtggggattccttagcagaaacaagaagccccggatctgtacgcgcgaagagtttaccagaaaagttcggtctaatgccgctattggcgccgtgttcgtcgacgaaaaccagtggaatagcgccaaggaggcggtggaggatgaacgcttttgggacctggttcataaagagagagaactccacaagcaggggaaatgcgctacatgcgtgtacaacatgatgggaaagcgggagaagaaactgggcgagttcgggaaggccaaaggctcccgcgccatctggtacatgtggctgggagctagatttctcgagttcgaggccctgggcttcatgaatgaagatcactggttttctcgggagaacagcctttccggggtcgaaggagagggcctgcataagctcgggtatattctgcgcgacatctctaaaatccctggaggcaatatgtacgctgatgacaccgccgggtgggatacaagaattaccgaggacgatcttcagaacgaagcgcggatcacagacattatggagcccgaacacgccctgctcgctaagagcatcttcaaactgacctatcaaaataaggtggtccgcgtgcagagacctgccaagaacggcacggttatggatgtgatttcccggcgcgaccagagaggatctggccaggtcgggacctacggactgaatacatttaccaacatggaggctcaactcatccggcagatggaaagcgagggcatcttctcccccagcgagctggaaacaccgaaccttgccgagagagtgctggattggctcgaaaaatatggggtggagcgcctgaagcggatggcgatttctggagacgactgtgttgtgaaacctatcgatgacagatttgccaccgctcttacggccctgaatgatatgggcaaggtccgcaaagacattccccagtgggaaccttccaaggggtggaacgattggcagcaagtgcccttctgcagccatcactttcaccagctcatcatgaaggacggccgggagattgttgtgccttgtagaaatcaggatgagctggtcggacgcgctcgggtgtctcagggcgccgggtggtccctgagagaaacagcttgcctcggaaaaagctacgcccaaatgtggcagctgatgtatttccatcgccgggaccttagactggcggccaacgctatctgttccgccgtccccgtggattggattccgacctctcgcacaacctggagcatccacgcccatcaccagtggatgacgaccgaggacatgctctccgtttggaatcgggtgtggatcgaagagaacccttggatggaagataagacacatattagctcttggggcgacgtcccctacctggggaaaagagaggaccaatggtgcggatcccttatcggcctgaccgctcgggccacatgggcgaccaatattcaggtggctatcaaccaggttagacgcctcattgggaatgagaactacctggattatatgacaagcatgaagcggtttaaaaatgaatctgaccccgagggcgccctgtggtga

SEQ ID NO: 18492 - RNA, 9879 nt, synthetic construct
  misc_feature 1..9879: note = derived and/or modified CDS sequence (opt5) from DENV-1__KJ649286__SS-prME
  source 1..9879: mol_type = other RNA
agcgtgaccatgctgctcatgctgcttcccaccgtcctggccttccacctcacgaccagaggcggggagcctcatatgatcgttacaaagcaggaacggggaaaatccctgctttttaagacctctacaggcgtgaacatgtgcaccctgattgctatggacctcggggagctgtgtgaagatacaatgacctacaaatgcccgcgcatcacggaggccgaacccgacgatattgactgttggtgcaatgcgaccgatacatgggtgacctatggaacatgtagccaaaccggcgagcacagacgggacaagcgctccgtcgctctggcccctcatgtggggctcggactggagacgagaacagaaacctggatgtctagcgagggcgcctggaaacagatccagcgggttgaaacatgggctcttagacaccccggcttcaccgtgaccgccctgtttctcgctcatgccattgggacatccatcacgcagaagggaatcattttcatcctgcttatgctggtcaccccttctatggcgatgagatgcgtgggcattgggaaccgggattttgttgagggactcagcggcgccacatgggtggacgtcgtgctggagcacgggtcctgtgtgaccacaatggctaaggataaacccaccctggacatcgaactcctgaagacggaggtcacaaatcctgccgttcttcgcaaactgtgcattgaagctaagatcagcaacaccaccacagattctagatgtccgacccaaggagaggccacactcgtggaggaacaggacgcgaatttcgtgtgccggcgcacgtttgtcgatagaggctggggcaacgggtgtggactgttcggcaaagggtcccttattacctgcgccaagtttaagtgcgtgacaaaactggagggaaagatcgttcagtacgaaaatctcaaatatagcgtgatcgtcaccgtgcacacaggcgaccagcatcaagttgggaacgagtctaccgaacacggaacgaccgctacaattacaccccaggcccctacatccgagatccagctgaccgactacggcgctctgacgctcgattgtagcccccggacaggcctggacttcaatgaaatggtgcttctgaccatgaaggagaaatcttggctcgtccataagcagtggtttctggatcttcctctgccctggacatccggggccaccaccagccaagagacatggaaccgccaggacctcctggtgacgttcaaaaccgcccacgctaagaagcaggaagtcgtggttctgggatcccaagagggcgcgatgcacacagccctcaccggggctacagaaattcagacctctggaacgacaaccatctttgccggccatctgaaatgcagacttaagatggataaactgaccctcaaggggatgagctatgtgatgtgtacaggctccttcaaactggagaaggaagtcgtggagacccagcacggaacagttctggtgcaggtcaagtacgagggcacggacgccccgtgcaaaattcctttccttacccaagatgaaaagggggtgacacagaatggacgggtgatcaccgctaaccccatcgttacagacaaagagaagcctgtcaatattgaagccgagccgccctttggcgagagctatatcgtggtgggggcgggagaaaaagctctcaagctgtcttggttcaagaaaggctccaccattgggaagatgtttgaggccacggccagaggcgctcgccggatggccatcctgggagataccgcttgggacttcggcagcattgggggagtctttacatctgtgggcaaactcgttcatcagatcttcgggaccgcctacggagtgctgtttagcggcgtctcctggacaatgaagatcgggattggcgtgcttctgacctggctcggactgaactctagaagcacatccctgagcatgacctgtatcgcggttggccttgtgacgctctacctgggggtcatggtgcaggccgattctggatgcgttattaattggaaaggccgcgaactgaagtgtgggtccggaatcttcgtgacaaacgaggtccacacctggaccgaacaatataagtttcaggctgacagccctaaacggctctctgccgctattggcaaggcctgggaggagggggtgtgcggcatcagatccgcgacacgcctggaaaacattatgtggaaacagatcagcaatgagcttaaccatatcctgctcgaaaatgacatgaagttcaccgtggtcgttggagatgtgtccggcattctggcccaggggaaaaagatgatccggccgcaacccatggagcacaaatactcttggaaaagctggggaaaggctaagattatcggcgccgacgtgcagaactccacgtttattatcgatgggcctaatacacccgaatgtcctgacgatcagagagcttggaacatctgggaggtcgaggactatggattcggcatttttaccacaaatatctggctgaaacttcgcgattcttacacccaggtgtgcgaccaccggctcatgagcgccgccattaaagattccaaggctgttcatgcggacatgggctattggatcgaaagcgagaaaaacgaaacatggaagctggccagagcttctttcattgaggtgaagacctgtgtctggcccaaatcccacacgctgtggagcaatggggtgctcgaatctgagatgatcatcccgaagatttacggaggccctatctcccaacataactatcgccccgggtacttcacccagacagccggaccttggcacctgggcaaacttgagctggattttgacctctgcgaagggaccacagttgtggtcgatgagcactgcggaaatcggggccccagcctgagaaccacgacagtgaccggcaagattatccatgaatggtgttgccggtcttgtacactgcctccccttcgcttcaaaggggaggacggatgctggtacggcatggagattagaccggttaaggaaaaggaggaaaacctcgtgaaaagcatggtctccgccgggagcggagaggtggactctttttccctgggcctgctctgtatcagcatcatgattgaagaggtgatgcggtccagatggtctcgcaagatgctgatgaccgggacccttgctgtcttcctgctcctgatcatgggacagctgacatggaatgatcttattcggctgtgcatcatggttggcgccaacgcgagcgacagaatgggcatggggacgacctatctcgctctgatggccacatttaaaatgcgccctatgttcgccgtgggactcctgtttagacggcttacctcccgcgaggtgctgctcctgacaattggcctgtctcttgtcgctagcgtggaactgcccaattccctcgaggaactgggggatggactcgccatgggcatcatgattctgaaacttctgaccgacttccaatctcaccagctctgggcggctctgctgagccttacgtttatcaaaacaacctgttccctgcattacgcctggaagaccatggccatggttctcagcatcgtgtctctgttccccctctgcatgtccacaaccagccagaagacaacgtggctgcctgtccttctggggtctctgggatgtaaaccgctcaccatgtttctgattgctgagaacaagatctggggcagaaaatcctggccccttaacgaaggcattatggccgtggggatcgttagcattctgctctcttccctgctcaagaatgatgtgcctctggctggaccccttgtcgccggcgggatgctgatcgcgtgctatgtgatcagcggatccagcgccgacctgtctctcgagaaagctgccgaggtcagctgggaagaggaagctgagcactccggcgcctctcataacattctggtggaagttcaggatgacgggacaatgaagatcaaagatgaggagcgggacgatacccttacaattctgctcaaggccaccctgctcgctgtgagcggagtctaccctctgtccatccccgcgacgcttttcgtgtggtatttttggcaaaagaaaaagcagcgctctggcgttctgtgggacacccctagccctcccgaagtggagagagccgtcctggatgacggcatttaccggatcatgcagcgcgggctcctgggaagatcccaggtgggcgtgggggttttccaagaaaatgtcttccacacaatgtggcacgtgacccggggagctgtgcttatgtataaaggcaagcgcctggagcccacatgggcctctgtcaaaaaggacctcatcagctacgggggaggctggagactgcagggctcctggaacaccggggaggaagtgcaggttattgccgtggagcccggaaagaatcctaaaaacgtccagacagctcccggcacgtttaagaccccggaaggggaggtgggagccatcgcgctcgatttcaaacctggcacaagcgggtctcccattgttaatcgggaaggaaagatcgtgggcctgtacggcaacggggtcgtgaccacctccggaacatatgttagcgctattgcccaagccaaggcttctcaggagggccctcttcccgagatcgaagacgaggtgtttagaaagcgcaatctgacgattatggatctgcatcccgggtccggaaagacccggagatacctccctgccatcgtccgcgaagcgatcaaacggaagctgagaacacttattctggctccgacccgcgtggtggccagcgagatggccgaagctctcaaaggcatgcccatccggtatcagacaaccgccgtcaagtccgagcacacggggaaagagattgttgacctgatgtgtcatgctacattcaccatgagactgctctctcctgtgcgcgtgcccaactacaatatgatcattatggatgaagcccactttaccgaccctagctccatcgcggcccggggctatatcagcacaagagtcggaatgggcgaggctgccgctattttcatgaccgccacaccccctgggtctgtggaagcctttccgcaatccaacgctgttatccaggatgaggaacgggacattcccgagcgcagctggaactctggatacgattggatcaccgacttccctggcaagacggtgtggtttgtccccagcattaagtccgggaacgatatcgcgaattgccttcgcaagaatggaaagcgggtgatccagctgtctcgcaaaacattcgacaccgagtatcagaagaccaagaacaatgactgggattacgttgtgaccacggacattagcgaaatgggcgccaactttagagctgatcgggtcatcgaccctagacgctgcctgaagcccgtgattctcaaggatgggccggagcgggtcatcctggccggccctatgcccgtgaccgttgcctccgctgcccaaagacgcggacggattggcagaaatcagaacaaagaaggggaccagtacatctatatgggacagccccttaataacgatgaggaccatgcgcactggacagaggctaagatgctgctcgataatattaacacccctgaaggcatcatccccgccctgttcgagcctgaacgcgagaaatctgccgctattgacggggaataccggctgagaggagaggcccgcaagacattcgtggagctcatgagacggggcgatcttccggtgtggctgagctataaagtcgcgtccgaagggtttcaatacagcgaccgcagatggtgtttcgatggcgagcggaataaccaggttctggaagagaatatggacgtggaaatctggaccaaggagggagagcgcaaaaagctcagaccccggtggctggacgccagaacatattctgatcctcttgctctgcgcgaatttaaggagttcgccgctggccggagatccgtgagcggggacctcattctggaaatcggaaaactgccccagcacctcacccagcgcgcccaatccgctcttgataacctggtcatgctgcataattctgagcagggcgggcgggcctacagacacgcgatggaggaactccctgacacgattgagacactgatgcttctggccctcatcgctgtgctgaccggaggcgttaccctgtttttcctcagcggcaaggggcttggaaaaacatccatcggcctgctgtgcgtgatggcctctagcatgctcctgtggatggcttccgtcgaaccccattggattgccgccagcatcattcttgagtttttcctgatggtgctcctgatcccggaacctgatcggcagcgcacaccccaggacaaccaactggcttatgtcgtgattgggctcctttttatgatcctgacagttgcggccaatgagatgggactgctcgagacgaccaagaaagatctgggcatcgggcacgtggctgtcgaaaaccaccatcacgccacaatgcttgacgtggatctgcatcctgcctctgcttggaccctctacgccgttgcgacaaccattatcacgcccatgatgagacacaccattgagaacacaaccgccaatatctccctgacagctattgccaaccaggctgccatcctgatgggactcgacaagggctggcctattagcaagatggatatcggcgtgccccttctggcgctggggtgttactctcaggtcaatccgatgaccctcacggccgctgtgctgatgcttgtggcccattatacaatcattggacctggcctgcaagctaaagccacccgggaagctcagaagcgcacagccgcggggatcatgaaaaaccccaccgttgacggaattgtcgccatcgatctcgaccccgtggtgtacgacgctaagttcgagaaacagctgggccagattatgctgctcatcctttgcacctcccaaatcctgctgatgagaacaacgtgggccctctgtgaaagcattaccctggctacagggcctcttaccacactgtgggagggatctccgggcaagttttggaataccacgatcgccgtcagcatggccaacattttccggggctcctatctcgcgggggctggactggccttttctctgatgaaaagcctcggcgggggacgcagaggcacaggggctcagggagagacccttggcgaaaaatggaagcggcagctgaatcagctgtccaaaagcgagttcaacacctacaagcgctccggcatcattgaagttgatagatctgaggccaaagaagggctcaagcggggagagacaaccaagcacgccgtgagcagaggcacagctaaactgcgctggttcgtggagcggaatcttgtcaagcccgaagggaaagtgatcgacctgggatgcggcagagggggatggtcctattactgtgccggcctcaagaaagttacggaggtgaagggctataccaaagggggagcgggccacgaggaacctatccccatggccacatacgggtggaacctggtcaagctgcattctggaaaggatgtgtttttcattcctcccgaaaaatgcgacaccctcctttgtgatatcggcgagagctcccctaatccgacaattgaggaagggcgcaccctgcgggttctgaagatggtggagccctggctcagaggaaaccaattttgcatcaaaattctgaatccttacatgccctctgtcgtggaaacgcttgagcagatgcagcgcaagcacggcggcatgctggtgcggaaccctctcagcagaaattccacccatgagatgtattgggtcagctgtgggacaggaaacatcgtttctgctgtgaatatgacctcccgcatgctgctgaaccggttcacaatggcccacagaaaacccacctacgaacgcgacgtggatctcggcgctgggacacggcacgtcgccgtggagccggaagttgcgaacctggacattatcggacagagaatcgagaatattaagcatgaacacaagagcacctggcattatgatgaggacaacccttacaaaacgtgggcctatcacggctcttacgaggtgaagccctccgggagcgcttcttccatggtcaatggagtggttcgccttctgacaaaaccctgggatgtgatccctatggtcacccaaattgccatgaccgacacaacgccctttggccagcagagagtgttcaaggaaaaagttgacacccggacacctaaggctaagcgcggcaccgcccaagtgatggaggtcacagctagatggctctgggggtttctgagccggaacaaaaagccgagaatctgcacccgggaagagttcacacgcaaagtgagatccaatgccgcgattggagccgtctttgtggatgaaaaccagtggaatagcgctaaggaggccgttgaggacgaacggttctgggatcttgtgcatcgcgagagagaactgcacaaacagggcaagtgcgctacctgtgtctataacatgatggggaagcgggagaaaaagctcggagaatttggcaaagccaaggggtctcgcgccatctggtacatgtggctgggcgcgagattcctggagtttgaggctctcggattcatgaatgaagaccactggttcagccgggagaactccctgtctggcgtggaaggggagggacttcatcgcctgggctacatcctcagagatattagcaaaatccccgggggaaatatgtatgccgacgatacggccggctgggacacccggattacagaggatgacctgcagaacgaagctaagatcaccgatattatggagcctgaacacgcccttctggctacatccatctttaaactcacctaccaaaataaggtggttcgcgtgcagagacccgccaagaacgggacggtcatggacgtgatctctcggcgcgatcagagaggcagcggacaggttggcacatatgggctgaataccttcacaaacatggaggcgcaactgattcggcagatggaatccgagggactcttttctcctagcgagctggaaacccccaaccttgccgagagagtgctgaattggctcggcaaatacggggtcgaacgcctgaagcggatggctatctccggagacgactgcgtggtcaaaccgattgatgacagattcgccacggctcttaccgccctgaacgatatgggcaaggtgcgcaaagacatccctcagtgggagcccagcaaggggtggaatgattggcagcaagttcctttttgttctcatcacttccaccagctcattatgaaggacggccgggaaatcgtggtcccctgcagaaaccaggatgagctggtgggacgcgcgcgggtttcccagggcgccgggtggagcctgagagagacagcttgtctcggaaaatcttatgcccaaatgtggcagctgatgtactttcatcgccgggaccttagactggctgccaatgctatctgctccgccgtgcctgtcgattgggtgcccaccagccgcacaacctggtccattcacgcgcatcaccagtggatgacaaccgaaaacatgctctctgtgtggaatcgggtttggatcgaggaaaacccgtggatggaggacaagacgcatgtcagctcctgggaagatgtgccttatctgggcaaaagagaggaccaatggtgtgggagccttattggactgacagcccgggctacctgggccaccaatatccaggtggccattaaccaggtcagaaagctcatcggcaatgagaactacctggactacatgacatctatgaaacgcttcaagaatgattccgaccccgaaggggctctgtggtga

SEQ ID NO: 18493 - RNA, 9879 nt, synthetic construct
  misc_feature 1..9879: note = derived and/or modified CDS sequence (opt5) from DENV-1__KF887994__SS-prME
  source 1..9879: mol_type = other RNA
agcgtgaccatgctgctgatgctgatgcccacagcccttgctttccacctgacgaccagaggcggggagcctcatatgatcgtgtccaagcaggaacggggaaagtctctgctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgctggaggccacagctagaggcgcccgccggatggcgatcctgggagataccgcctgggactttggctctattgggggagtgttcacaagcgttggcaaactcgtccatcagatctttgggaccgcttacggagtgctgttctccggcgtgagctggacgatgaagattgggatcggcgtccttctgacctggctcggactcaattctagatccacaagcctgtctatgacctgtattgccgtgggccttgttacactctacctgggggtgatggtccaggctgattccggatgcgtgatcaactggaaaggccgcgaactgaagtgtgggagcggaatttttgttaccaatgaggtgcacacatggaccgaacaatataagttccaggccgactcccctaaacggctctctgcggccatcggcaaggcttgggaggagggggtctgcggcatcagaagcgccacgcgcctggaaaacattatgtggaaacagatctccaacgagcttaatcatattctgctcgaaaacgacatgaagtttacagtggttgtgggagatgtcgctggcatcctggcccaggggaaaaagatgattcggccgcaacccatggagtacaaatattcttggaaaagctggggaaaggccaagatcatcggcgctgacgtgcagaataccaccttcattatcgatgggcctaacacacccgaatgtcctgacgatcagagagcgtggaatatttgggaggtggaggactacggatttggcatcttcaccacgaacatttggctgaaacttcgcgattcctatacacaggtctgcgaccaccggctcatgagcgccgctatcaaagattctaaggccgttcacgccgacatgggctactggatcgaatccgagaaaaatgaaacctggaagctggctagagccagctttattgaggtgaagacatgtatctggcccaaatctcataccctgtggtccaacggggtgctcgaaagcgagatgattatcccgaagatttatggaggccctatctctcaacacaattaccgccccgggtacttcacacagaccgcgggaccttggcatctgggcaaacttgagctggatttcgacctctgcgaagggacgaccgtcgtggttgatgagcactgcggaaaccggggccccagcctgagaacaaccacagtgaccggcaagatcattcacgaatggtgttgccggtcctgtacgctgcctccccttcgctttagaggggaggacggatgctggtatggcatggagatccggccggtcaaagaaaaggaggaaaatctcgtcaagagcatggtttctgctgggtccggagaggtggacagcttctccctgggcctgctctgtatttctatcatgattgaagaggtcatgagaagccgctggtcccggaaaatgctgatgacagggacccttgccgtgtttctgctcctgatcattggacagctgacatggaacgatcttatcagactgtgcatcatggttggcgccaatgcttctgaccgcatgggcatggggaccacctacctcgccctgatggcgacattcaagatgagacctatgtttgctgtgggactcctgttccggcgccttacgagcagagaggtcctgctcctgaccattggcctgtcccttatggcctctgtggaactgcccaacagcctcgaggaactgggggatggactcgccatgggcatcatgattctgaaacttctgacagactttcaatcccatcagctctgggctaccctgctgagccttacattcatcaagaccacgttttctctgcactatgcctggaaaacaatggctatggtgctctccattgtcagcctgttccccctctgtctgtctaccacctcccagaagacaacctggcttcctgttctgctggggagcctcggatgcaagccgctgacaatgtttcttatcgccgagaataaaatctggggccggcgctcttggcccctgaacgaaggcattatggcggtggggatcgtgtccattctcctgagctccctcctgaagaacgatgtccctcttgccggacccctgatcgctggcgggatgctgattgcctgttacgtgatcagcggatctagcgctgacctctccctggagaaagccgccgaggtttcttgggaagaggaagctgagcatagcggcgcgtcccacaatatccttgtggaagtccaggatgacgggacgatgaagattaaagatgaggagagagacgataccctgacaatcctcctgaaggccaccctcctggctgtgtctggagtttatcctcttagcattcccgccacactgttcgtgtggtacttttggcagaagaagaagcagcggtccggcgtcctgtgggacaccccttctcccccggaagtggagcgcgccgtcctcgatgacggcatctatagaattatgcagcgggggctgcttggacgcagccaggtgggcgttggggtgttccaagaaaacgtcttccatacgatgtggcacgtgaccagaggagctgttctgatgtaccagggcaaacggctcgagccttcctgggccagcgtgaagaaagacctgatctcttacgggggaggctggagactccagggctcctggaatacaggggaggaagtccaggtgattgcggtggagcccggaaagaaccctaaaaatgttcaaaccgctcccggcacatttaagaccccggaaggggaggtcggagccatcgccctggatttcaagcctggcacaagcgggtctcccatcgtgaaccgcgaaggaaaaattgtgggcctttatggcaatggggtcgtgacgacctccggaacatacgttagcgctatcgcccaggcgaaggcttcccaggagggccctctgcccgagattgaagacgaggtgtttcggaaaagaaacctgaccatcatggatctccaccccgggtctggaaagacccgccggtatctgcctgccattgtcagagaagccatcaaacgcaaacttcggacactgatcctcgctccgacgagagtggttgccagcgagatggctgaagccctgaagggcatgcccattcgctaccaaaccacagcggtgaaatccgagcataccgggaaggagatcgtcgacctgatgtgccacgccacattcaccatgcggctccttagccctgtgagagttcccaattataacatgattatcatggatgaagctcattttacggacccttcttccattgccgctcggggctacatcagcacacgcgtgggaatgggcgaggccgccgctatcttcatgaccgcgacaccccctgggtctgtcgaagcctttccgcagagcaatgctgtgattcaggatgaggaaagagacatccccgagcggtcctggaactctggatatgagtggattacagatttccctggcaaaaccgtgtggtttgtccccagcatcaagtccgggaatgacattgccaactgtctgcgcaaaaatggaaagagagttatccagctgtctcggaagacattcgataccgaataccagaagacgaagaacaacgactgggactacgtggtgacaaccgatattagcgagatgggcgccaattttagagctgaccgcgtcatcgatcctcggagatgcctcaaacccgtgatcctgaaggacgggccggaacgcgttattcttgccggccctatgcccgtgacagtcgcgtccgctgcccagcggagaggacgcatcggccggaaccacaataaagagggggatcagtatatttacatgggacagcccctgaacaatgacgaggatcatgcccactggaccgaagctaagatgctcctggacaacatcaatacgcctgagggcattatccccgccctgttcgaacctgagagagaaaagagcgcggccatcgatggggagtatcgcctcagaggagaggctcggaaaaccttcgtggaacttatgcgcagaggcgacctgccggtttggctgtcttacaaggtggcctccgaggggtttcaatatagcgatcggcgctggtgcttcgacggcgaaagaaacaatcaggtcctcgaggaaaacatggatgtggagatttggacaaaagagggagaacggaagaaactgagaccccgctggcttgacgctcggacctactccgaccctctggccctcagagagtttaaggagttcgctgccggccgccggtctgtcagcggggatctgatcctggagattggaaaactcccccagcaccttacacagagagcgcaaaatgccctggacaacctggtgatgctccataattccgaacagggcgggcgggcttatcgccacgccatggaggagctgcctgataccatcgaaacacttatgctgctcgctctgattgccgttctgaccggaggcgtgacgctctttttcctttctggcagagggctgggaaagacaagcatcggcctgctctgtgtgatggcctccagcgtcctgctttggatggcttctgttgagccccattggatcgcggcctccattatcctggaatttttcctcatggtgctgctgattccggagcctgaccggcagcgcacaccccaagataaccaactcgcttacgtggtcatcgggcttctgtttatgattctgaccgtggccgccaatgagatgggactcctggaaaccaccaagaaagaccttggcatcgggcacgttgctgtgggaaaccaccatcacgccgcgatgctggatgtcgacctccatcctgccagcgcttggacactgtacgccgtggctacgaccattatcacacccatgatgagacacaccatcgagaacacaaccgccaatatttctctgacggcgatcgccaaccaggctgccattctcatgggccttgataagggctggcctatctccaaaatggacattggggtccccctgctggctctcggatgctatagccaggtgaatccgctgacccttacagccgctgttctgatgctcgtggcccattacgcgatcatcggccctgggctgcaagccaaggctacccgggaagcccagaaacgcacagctgccggaattatgaagaaccccaccgtcgatggcatcgtggccattgacctggatcccgttgtgtatgacgcgaagttcgagaaacagctcgggcagatcatgcttctgattctgtgtacgtctcaaatcctcctgatgagaacaacctgggctctttgcgaaagcatcacactggccaccggacctctcaccacactgtgggagggctccccgggcaagttttggaatacgaccattgctgtctctatggccaacatcttccgggggagctacctggccggagctggcctcgccttttcccttatgaaaagcctcgggggaggccgcagagggacaggagcgcagggcgagaccctgggcgaaaagtggaaacggcagctcaatcagctgtccaagtctgagttcaacacatataagagaagcgggattatggaagtggaccgctccgaggccaaagaaggacttaagcggggcgagaccacgaaacacgctgtgtctagagggacagccaagctgcgctggttcgttgagcggaatctcgtcaaacccgaaggaaaggtgatcgatctgggctgtgggagaggaggctggagctactattgcgctggcctgaagaaagtgaccgaggtcaaggggtacaccaaaggaggccctgggcacgaggaacccattcctatggccacatacggatggaacctcgttaaacttcattccggcaaagacgtgtttttcattccccctgaaaagtgtgataccctgctgtgcgacatcggggagtctagcccgaatcccacaatcgaggaaggacgcacgctccgggtgctgaaaatggtcgagccttggcttagaggcaaccaattttgtatcaagattctgaatccctatatgccttccgtggttgaaaccctcgagcagatgcagcgcaagcacggcgggatgctggtgcggaaccccctgagcagaaattctacacatgagatgtactgggtctcctgcggaaccggcaacatcgtgagcgcggttaatatgacatctcgcatgctcctgaaccggttcaccatggcccacagaaaaccgacgtatgaacgcgatgtggaccttggggctggaaccagacacgtcgccgtggagcctgaagtggctaacctggatattatcggccagcggattgagaatatcaagcatgaacacaaatccacatggtactatgacgaggataacccctacaagacctgggcctatcatgggagctacgaggtcaaaccctctggatccgctagctccatggttaatggcgtggtgaagctcctgacaaagccttgggacgtcatccccatggtgacccaaattgccatgacagataccacgccttttggccagcagcgcgttttcaaagaaaaggtggacacaagaaccccgaaagcgaagcgggggaccgcccaaatcatggaggtcacagctaaatggctttggggatttctgagcagaaacaagaagccccggatttgtacgcgcgaagagttcaccagaaaagtgcggtctaatgccgctatcggcgccgtttttgtggacgaaaaccagtggaatagcgccaaggaggcggtcgaggatgaacgcttctgggacctcgtgcacaaagagagagaactgcataagcaggggaaatgcgctacatgcgtttacaacatgatgggaaagcgggagaagaaactgggcgaatttgggaaggccaaaggctcccgcgccatttggtatatgtggctcggagctagattcctggagtttgaggcccttggcttcatgaatgaagatcactggttctctcgggagaacagcttttccggggtggaaggagagggcctgcacaagctcgggtacatcctgcgcgacatctctaaaattcctggaggcaatatgtatgctgatgacaccgccgggtgggatacaagaatcaccgaggacgatcttcagaacgaagcgcggattacagacatcatggagcccgaacatgccctgctcgctaagagcattttcaaactgacctaccaaaataaggtcgtgcgcgtccagagacctgccaagaacggcacggtgatggatgttgtgtcccggcgcgaccagagaggatctggccaggtcgggacctatggactgaatacatttaccaacatggaggctcaactcatccggcagatggaaagcgagggcatcttctcccccagcgagctggaaacaccgaaccttgccgagagagtgctggcgtggctcgaaaaatacggggtggagcgcctgaagcggatggccatttctggagatgactgtgttgtgaaacctatcgacgatagatttgctaccgcccttacggctctgaatgacatgggcaaggtccgcaaagatattccccagtgggaaccttccaaggggtggaacgactggcagcaagtgcccttctgcagccaccattttcaccagctcatcatgaaggatggccgggagattgttgtgccttgtagaaatcaggacgagctggtcggacgcgcccgggtgtctcagggcgctgggtggtccctgagagaaacagcctgcctcggaaaaagctatgcgcaaatgtggcagctgatgtacttccaccgccgggatcttagactggccgctaacgccatctgttccgccgtccccgtgaattggattccgacctctcgcacaacctggagcatccatgctcaccatcagtggatgacgaccgaggacatgctctccgtttggaaccgggtgtggatcgaagagaatccttggatggaagataagacacacattagctcttggggcgacgtcccctacctggggaaaagagaggatcaatggtgcggatcccttatcggcctgaccgcccgggcgacatgggctaccaacattcaggtggccatcaatcaggttagaaagctcattgggaacgagaattatctggactacatgacaagcatgaaacgctttaagaacgaatctgaccccgagggcgccctgtggtga

SEQ ID NO: 18494 - RNA, 9879 nt, synthetic construct
  misc_feature 1..9879: note = derived and/or modified CDS sequence (opt5) from DENV-1__JQ675358__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaaatctctgctttttaagacaagcgctggcgttaacatgtgcaccctgattgcgatggacctcggggaactgtgtgaagatacaatgacctacaaatgcccccaaatcacagaggctgaacccgacgatgtggactgttggtgcaatgccaccgatacgtgggtgacctatggaacatgttcccagaccggcgagcacagaagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagcggtcttggctggtgcataaacaatggtttcttgacctgcctctcccctggacgtccggggctagcacatcccaggagacctggaatcgccaggatctgctggtcacattcaagaccgcgcacgccaaaaagcaagaagtggtcgtgctcggatctcaggagggcgctatgcacaccgccctgacaggggccacggaaatccagaccagcggaacaaccacaatttttgctggccatcttaagtgcagactgaaaatggacaagctcaccctgaaagggacgtcctatgttatgtgtacaggcagcttcaagctggagaaagaagtggccgagacccagcacggaaccgtccttgtgcaagttaagtacgagggcacagatgcgccgtgcaagatccctttctctacccaggacgaaaaaggggtgacacagaacggacggctcatcacggctaatcccattgtcaccgataaggagaaacctgtgaacatcgaaacagagccgccctttggcgagtcctatattgtggttggggccggagaaaaggccctgaaactgagctggttcaagaagggctctagcatcgggaaaatgtttgaggctaccgccagaggcgctcgccggatggccattctcggagacacagcgtgggatttcggctccatcgggggagtctttacctctgtgggcaagctggtgcatcaggtcttcgggacggcctacggagtgctttttagcggcgtttcctggaccatgaaaatcgggattggcatcctgctcacatggctgggactgaatagcagatctacctcccttagcatgacatgtattgctgtgggcatggtcaccctctacctgggggtgatggttcaagccgactctggatgcgtgatcaactggaagggccgcgaactgaaatgtgggtccggaattttcgtcacaaacgaggtgcacacctggacggaacagtataagtttcaggctgatagccctaagcggctctccgccgcgatcggcaaagcctgggaggagggggtttgcggcattagatctgctacacgcctggaaaatatcatgtggaagcagatcagcaacgagcttaatcatattctgctcgaaaacgacatgaaattcaccgtggtcgtgggagacgccaatggcatcctggctcaagggaagaaaatgattcggccgcagcccatggagcacaagtactcctggaaatcttggggaaaggccaagatcattggcgccgatatccagaacaccacatttatcattgacgggcctgatacccccgaatgtcctgacaatcagagagcttggaacatctgggaggtggaggattatggattcggcatttttacgacaaatatctggctgaaacttcgcgacagctacacccaaatgtgcgatcaccggctcatgtccgcggccattaaggacagcaaagctgtccatgccgatatgggctattggatcgaatctgagaagaacgaaacatggaaactggccagagcttccttcatcgaggttaagacctgtacatggcccaagagccacaccctgtggtctaatggggtgctcgaatccgagatgattatcccgaaaacgtacggaggccctattagccagcataactatcgccccgggtacttcacccagacagccggaccttggcacctgggcaaacttgagctggactttgatctctgcgaagggaccacagtggtcgtggacgagcactgcggaaatcggggcccctctctgagaaccacgacagttaccggcaaaatcattcatgaatggtgttgccggagctgtacactgcctccccttcgcttcagaggggaggatggatgctggtacggcatggagatccggccggtgaaggaaaaagaggaaaacctcgtcagatccatggtgagcgcggggtctggagaggttgactcctttagcctgggcatcctgtgtgcttccattatgatcgaagaggtgatgcgctctcggtggagcagaaagatgctcatgaccgggaccctggccgtcttccttctgctcattatgggacaactgacatggaatgacctgatccgcctttgcattatggtgggcgccaacgcttccgatagaatgggcatggggacgacctatctggccctcatggcgacatttaagatgcggcctatgttcgctgttggactgctctttcgcagactgacctctcgggaggtgcttctgctcacaatcggcctgagcctggtcgcctccgtggaacttcccaactctctggaggaactcggggacggactggccatgggcattatgatgctcaaactgcttaccgagttccagccccaccagctgtggacgacactcctgagcctgacctttatcaagaccacactttccctggattacgcttggaaaaccacagccatggctctcagcatcgtgtctctgttccctctctgtctgtccacgaccagccagaagacaacctggcttccggtcctgctggggtcttttggatgcaaacccctcacaatgttcctgattaccgaaaataagatctggggccgcaagtcctggcctcttaacgagggcattatggccatcgggattgttagcctgctcctgtcttccctcctgaaaaatgacgtgccccttgcgggacctctgatcgccggcgggatgctgatcgcttgttatgtgattagcggatccagcgccgatctctctctggagaaggctgccgaagtcagctgggagcaagaagccgagcattccggcacgtctcacaacatccttgtggaagttcaggacgatgggaccatgaaaattaaggacgaggagagagatgacacactgaccatcctcgtgaaagctacactgctcgcggtcagcggagtgtaccccatgtccattcctgccaccctgtttgtttggtatttctggcagaagaaaaagcagcggtctggcgtgctttgggatacacccagcccgcctgaagtcgagcgcgctgtgctggacgatggcatctacagaatcctgcaacgggggctcctgggacgctcccaggtcggcgtgggggttttccaggacggagtgtttcatacgatgtggcacgtcaccagaggcgccgtgcttatgtatcaggggaagcggctggaaccctcttgggccagcgttaaaaaggacctcatttcctacggaggcggctggagattccaagggagctggaatacaggagaggaggtgcaggtcatcgctgtggaacctcgcaaaaaccccaagaatgtgcagaccaccccgggcacatttaaaacgcctgagggggaagttggagccattgcgctggatttcaagcccggcacctctgggtcccctatcgtcaaccgggagggaaagattgtgggcctctacggcaatggggtggtcacaaccagcggaacatatgtgtctgctatcgcccaagccaaggcttcccaggaaggccccctgcccgagattgaggacgaagtttttaagaaaagaaaccttaccatcatggatctgcaccctgggagcggaaagacgcgccggtacctgccggccatcgtgagagaggcgattaaacgcaagctccggacactgatccttgctcccaccagagtcgtggcctccgaaatggccgaggctctgaagggcatgcctattcgctatcagaccacagccgttaaatctgaacataccgggcgggagatcgtggacctcatgtgccacgctacattcaccatgagactgctgagccccgtccgggtgcctaattacaacatgattatcatggatgaggcccattttacggaccccgcgtccatcgccgctcgcggctatattagcacaagagttggaatgggcgaagccgctgccatcttcatgaccgccacacctccggggtctgtggaggcttttccccagtccaatgcggtcattcaagatgaagaacgggacatccctgaacgcagctggaactctggatacgattggattaccgacttccccggcaagacggtgtggtttgtgcctagcatcaaatccgggaatgatatcgccaactgtctcagaaagaacggaaaacgggtcattcagctttctagaaagaccttcgacacagagtatcagaagaccaaaaataacgactgggattacgttgtgacaaccgacatcagcgagatgggcgctaatttccgcgccgatcgggtgattgaccccagacgctgcctgaagccggtcatcctgaaagatgggcctgaacgggtgattctcgccggccccatgcccgttacagtggcttccgccgcgcagagacgcggacggatcggcagaaaccaaaataaggagggggaccagtacgtctatatgggacagcctctgaacaatgatgaagaccacgctcattggaccgaggccaaaatgcttctggataacattaatacgcccgagggcatcatccctgccctctttgaaccggagcgcgaaaagtctgctgccattgacggggagtacagactgcggggagaagcgcgcaagacattcgtggagctgatgagacggggcgatctccccgtttggcttagctataaagtggcctccgaggggtttcagtacagcgaccgcagatggtgcttcgatggcgaacggaacaatcaagtcctggaggaaaacatggacgtggagatctggaccaaggaaggagagcgcaagaagctgcgccctcggtggctcgacgctagaacctattctgatcccctggcccttcgcgagtttaaagagttcgctgccggccggagatccgtcagcggggacctgattctcgagatcggaaagctgcctcagcacctgacactccgggctcagaatgcccttgataacctggtgatgctgcacaattccgaacagggcgggaaagcgtaccgccatgccatggaggaactccccgacaccattgagacactgatgcttctggctctcatcgccgttctgacgggaggcgtgaccctgtttttcctctctggcaaggggcttggaaagacaagcatcggcctgctgtgtgtgaccgcttcctctgccctcctgtggatggccagcgtcgagccgcactggattgctgcgtccatcattcttgaatttttcctgatggttctcctgatccctgagcccgatagacaacggacacctcaggacaaccagctggcctatgtggtgattgggctcctttttatgatcctgaccgtcgctgccaacgaaatgggactgctcgagacgaccaaaaaggatctgggcatcgggcatgtggccgctgagaatcaccaacacgccacaatgcttgacgttgatctgcgccccgcgagcgcctggaccctctacgctgtggccacaaccgtcattacgcctatgatgagacatacaatcgaaaacaccacagctaatatttctctgaccgccatcgcgaaccaggccgctattctgatgggactcgacaaaggctggcccatctccaagatggatattggcgtgccgcttctggccctggggtgctacagccaggtcaatcctctcaccctgacagctgccgtgcttatgctggttgctcactatgccatcatcggacccggcctccaggcgaaagccacgcgggaggctcaaaagcgcaccgccgctgggattatgaagaaccccacagtggacggaatcgtcgccattgatctggaccctgtggtttacgacaccaaattcgaaaagcagctgggccagatcatgctccttattctgtgtacatctcagatcctgctcatgagaaccacgtgggccctgtgcgagtccatcacacttgcgaccgggccgctgaccacactctgggaaggaagccccggcaaattttggaataccacaattgctgtgtctatggccaacatcttccggggcagctatctggctggggccggactggccttctccctcatgaagtctgtcggcgggggacgcagaggcatgggggctcaaggagagacgcttggcgagaaatggaagcggcagctgaatcagctgagcaagtccgaatttaacacctacaaaagaagcggcattatggaggtggatcgctccgaagccaaggaggggctcaaacggggagaaacaaccaagcatgcggtgtctagaggcacagccaaactgcgctggttcgttgagcggaatcttgtcaagcctgaggggaaggtgatcgacctgggatgtggcagagggggatggagctattactgcgctggcctcaaaaaggtgaccgaagtcaaaggctatacgaaagggggacccggccacgaggaacctattcccatggccacctacgggtggaacctggttaaactgcattccggaaaggatgtgtttttcatgcctccggagaaatgtgacacactcctttgcgatatcggcgaatctagccccaatcctaccatcgaggaggggcgcacactgcgggtgctgaagatggtcgaaccctggctcagaggaaaccagttttgtattaagatcctgaatccttacatgccctccgtggttgagacccttgaacaaatgcagcgcaaacacggcggcatgctggtgcggaacccgctctctagaaatagcacacacgagatgtattgggtctcctgcgggaccggaaacattgtgagcgctgttaacatgacgtctcgcatgctgctgaatcggttcacaatggcccatagaaagcctacctacgagcgcgacgtggatctcggcgcggggaccagacacgtcgccgtggaacccgaggtggctaacctggacatcattggacagcggatcgaaaatattaaaaacgagcataagtccacatggcactatgatgaagacaatccctacaaaacgtgggcctatcacggcagctacgaggtcaagccttctgggtccgctagctctatggttaacggagtggtgcgccttctgaccaagccctgggatgtcatccctatggtgacacaaatcgccatgaccgacacaaccccgtttggccagcagagagttttcaaagagaaggtggacacacggacccccagagctaaacggggcacgacccagattatggaagtcacagccaagtggctctgggggtttctgtcccgcaataaaaagcctagaatctgtacccgggaggagttcacacgcaaggtgagaagcaacgcggccattggagctgtttttgtggatgagaatcaatggaactccgccaaagaagctgtcgaggacgagcggttctgggatcttgtgcatcgcgaaagagagctgcacaagcagggcaaatgcgcgacctgcgtttataatatgatggggaagcgggagaaaaagctcggagagtttggcaaggccaaagggagccgcgccatctggtacatgtggctgggcgctagattcctggagttcgaggccctcggatttatgaacgaggaccattggttctctcgggaaaatagcctgtccggcgtggagggggaaggacttcacaagctgggctacattctccgcgatatctctaaaatccccgggggaaacatgtatgccgacgatacggctggctgggacacaagaattaccgaggatgacctgcagaatgaggccaagatcacagatattatggaacctgagcatgcccttctggccaccagcatctttaaactcacgtaccagaacaaggtcgtgcgggtccaacgccccgcgaaaaacgggaccgtgatggacgttatttccagacgggatcagagaggctctggacaggtgggcacatatgggctgcacaccttcacaaatatggaagtccagctgatccgccaaatggagagcgaaggaatctttctcccgtccgagctggagacccctaaccttgccgaacgggtgctggactggctcgagaagcacggcgctgaaagactgaagcgcatggccatttctggggacgattgtgtggttaaacccatcgacgatcggttcgctacagcccttaccgcgctgaatgacatgggaaaggtgagaaaagatattcctcagtgggagcccagcaagggctggaacgactggcagcaggtccctttttgctcccatcacttccatcaactcatcatgaaagatgggcgcgaaattgtggttccctgtcggaatcaggacgagctggtgggcagagcccgcgtcagccagggagctggctggtctctgcgggagacggcctgcctcgggaagtcctacgctcaaatgtggcagctgatgtattttcacagacgcgatcttcggctggccgctaacgccatctgtagcgcggtgccggtcgactgggtgcctacatctagaaccacctggtccatccacgcccatcaccagtggatgacaaccgaagatatgctcagcgtttggaatcgggtgtggattgaggaaaacccctggatggaggacaagacacatgtctcctcttgggaagaggtgccctacctgggaaaaagagaggaccagtggtgcggcagccttatcgggctgacggctcgcgccacctgggccacaaatattcaagttgctatcaaccaggtgcggagactcattggaaatgaaaactatctggattacatgacctccatgaagcgcttcaaaaatgagagcgaccctgaaggcgccctgtggtga

SEQ ID NO: 18495 - RNA, 9879 nt, synthetic construct
  misc_feature 1..9879: note = derived and/or modified CDS sequence (opt5) from DENV-1__FJ850070__SS-prME
  source 1..9879: mol_type = other RNA
agcgtgaccatgctgctgatgctgcttcccacagccctggctttccacctcacgaccagaggcggggaacctcatatgatcgtctccaagcaggaacggggaaaatctctgctttttaagacaagcgttggcgtgaacatgtgcaccctgattgccatggaccttggggaactgtgtgaagatacaatgacctacaaatgccccagaatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagaacaagatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagccgccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgctaatggcatccttgcccaggggaagaaaatgattcgcccgcaacccatggagcataagtatagctggaagtcctggggaaaagctaagatcattggcgccgatatccagaacaccacctttatcattgacgggcctgatacacccgaatgtcctgacgatcagcgggcctggaatatctgggaggtggaggactacggattcggcatttttaccacgaacatctggctcaaactgagagattctcacacacagatgtgcgaccaccgcctgatgagcgctgcgattaaggattccaaagccgtccatgctgacatgggctattggatcgaaagcgagaagaatgaaacctggaagctcgcccgggcctctttcatcgaggttaaaacatgtatttggcccaagtcccacaccctgtggagcaacggggtgcttgaatctgagatgatcattccgaaaatctacggaggccctatttcccaacataattatagacccgggtacttcacacagaccgctggaccttggcacctgggcaagctcgagctggattttgacctgtgcgaagggacgaccgtggtcgtggatgagcactgcggataccgcggccccagccttcggacaaccacagttaccggcaaaatcatccatgaatggtgttgcagatcttgtacgctccctcccctgcggttccgcggggaggacggatgctggtatggcatggagattagaccggtgaaggaaaaggaggaaaacctggtccggagcatggtgtccgccgggagcggagaggttgactctttttccctcggcatcctgtgtgtgagcattcttatcgaagaggtcatgagatcccgctggtctcggaaaatgctgatgacagggaccctcgcggtgttcctgctgcttattatgggacagctgacatggaatgatctcatcagactgtgcattatggttggcgctaacgccagcgaccgcatgggcatggggaccacctacctcgccctgatggctacatttaagatgagacctatgttcgccgtgggacttctgtttcggcgcctcacgtccagagaggtcctgctgcttaccatcggcctgtctctcgtggcgagcgtggaactgcccaattccctcgaggaactgggggatggacttgctatgggcatcatgatgctgaaactcctgacagacttccaaccccaccagctgtggaccacacttctgtctctcacctttattcggacgagcctgtccctcgattatgcctggaagacaatggccatggctctgagcatcgtctctcttttccctctgtgtctgtccaccaccagccagaaaacaacctggctcccggttctgcttgggtcttttggatgcaagcccctgacaatgttcctcattacggagaacaagatctggggccgcaaatcctggcctattaacgaaggcatcatggccgtggggatcgtgagcattctgctctcttccctgcttaagaatgacgtccccctggctggacctctgatcgccggcgggatgctcattgcgtgttacgtgatcagcggatccagcgccgatctgtctcttgagaaagctgccgaggttagctgggaagaggaagctgagcattccggcacctctcacaacattctggtggaagtccaggacgatgggacaatgaagatcaaagacgaggagagagatgacaccctcacaatcctgctcaaggccaccctgcttgccgctagcggagtgtatcccatgtccattcctgcgacgctgtttgtttggtacttctggcagaagaagaagcagcggtctggcgtgctgtgggatacccccagcccgcctgaagtcgagcgcgccgtgctcgacgacggcatctatcgcattctgcagcgggggcttctgggacgctcccaggtcggcgtgggggttttccaagatggagtgtttcatacaatgtggcacgtcaccagaggcgctgtgctcatgtaccaggggaaacggctggaaccctcttgggccagcgttaagaaagacctcatctcctacggaggcggctggagattccaggggagctggaatacaggagaggaggtgcaggtcattgccgtggaacctggcaagaaccccaaaaatgtgcaaaccacaccggggacgtttaagacccctgagggagaagttggcgctatcgccctggatttcaagcccgggacatctggatcccctattgtcaaccgcgagggcaaaatcgtgggcctttatgggaatggagtggtcaccaccagcggcacatacgtgtctgcgatcgctcaggccaaggcctcccaggaagggcccctgcccgagattgaggacgaagtttttaaaaagcggaacctgacgatcatggatctccaccctggaagcggcaaaaccagacgctatctgccggctattgtgcgggaggccatcaagagaaaacttcgcacactgattctcgcgcccacccgggtcgtggcttccgaaatggccgaggccctgaaagggatgcctatcagataccaaacaaccgctgttaagtctgaacatacgggccgcgagatcgtggacctgatgtgccacgccacattcaccatgcggctccttagccccgtcagagtgcctaattataacatgattatcatggatgaggctcattttaccgaccccgcctccattgcggcccggggatacatcagcacacgcgttggcatgggggaagctgccgctattttcatgaccgccacacctccgggatctgtggaggcctttccccagtccaatgctgtcatccaggatgaagagagagacatccctgaacggagctggaactctggctatgattggattaccgacttccccgggaaaacggtgtggtttgtgcctagcatcaagtccggaaatgacattgcgaactgtctgcgcaaaaatggcaagagagtcatccagctgtctcggaagacattcgataccgagtaccagaagacaaagaacaacgactgggattacgttgtgaccacggacattagcgagatgggggccaatttcagagctgatcgcgtgatcgacccccggagatgcctcaaaccggtcattctgaaggatggccctgaacgcgtgatccttgccggacccatgcccgttaccgtggcctccgctgcccagcggagaggccgcatcgggcggaaccagaataaagagggagaccagtatatttacatgggccaacctctgaacaatgatgaagaccacgcgcattggacagaggctaagatgctcctggataacatcaatacccccgaggggattatccctgccctgtttgaaccggagagagaaaagtctgccgctattgacggagagtatcgcctcagaggcgaagcccggaaaacattcgtcgagcttatgcgcagaggggatctgcccgtgtggctgagctacaaggttgcgtccgagggctttcagtatagcgaccggcgctggtgcttcgacggagaaagaaacaatcaggtgctcgaggaaaacatggatgtcgagatctggaccaaagaaggcgagcggaagaaactgagacctcgctggcttgacgcccggacatactctgatcccctggctctcagagagtttaaggagttcgccgctgggcgccggtccgtgagcggagacctgatcctggagattggcaaactccctcagcaccttaccctgagagcccaaaatgctctggataacctcgtcatgctgcacaattccgaacaagggggaaaggcctatcggcatgcgatggaggaacttcccgacacgatcgagacactgatgctcctggccctgattgctgtgctcaccggcggcgttaccctctttttcctgtctgggaagggactgggcaaaacaagcatcgggctcctgtgtgtgatggcctcctctgcccttctgtggatggccagcgtggagccgcactggattgccgcttccatcatcctcgaatttttcctgatggtcctgctcattcctgagcccgatcgccagagaacccctcaggacaaccaacttgcgtacgttgtgatcggactgctgtttatgattctcacagtggccgctaatgaaatgggcctgcttgagacgaccaagaaagatctggggatcggacatgtcgccgccgagaaccaccaccatgctacaatgctcgacgtggatctgcaccccgccagcgcgtggaccctgtacgccgttgctacaaccgtgattacgcctatgatgcggcataccatcgaaaacacaaccgccaatatttctctcacagctatcgccaaccaggcggccatccttatgggcctggacaagggctggcccatttccaaaatggatatcggggtcccgctgctcgctctgggatgctatagccaggtgaatcctcttaccctgacggccgctgtcctcatgctggtggcccactacgctattatcggccccgggctgcaagccaaggcgacacgcgaggcccagaagagaaccgctgccggaattatgaaaaaccccacagttgacggcatcgtgaccatcgacctcgatcctgtcgtgtatgacgctaagttcgaaaaacagcttgggcagattatgctgctgatcctctgtacctctcaaattctgcttatgcggacaacgtgggccctgtgcgagtccatcaccctcgccacaggaccgctgaccacactgtgggaaggcagccccggcaagttttggaataccacgattgcggtttctatggctaacatcttccgcgggagctacctcgccggagctggccttgccttctccctgatgaaatctctcgggggaggcagacgggggacaggagcccagggcgagaccctcggcgagaagtggaagcgccagctgaatcagcttagcaaatccgaatttaacacctataagaaaagcgggatcatggaggtggatagatccgaagctaaggagggactgaaacggggcgaaacaaccaagcatgccgtctctagagggacagcgaagctccgctggttcgtggagcggaatctggtgaaacctgagggaaaggttattgacctgggctgtgggagaggaggctggagctactattgcgccggcctcaaaaaggtcacggaagtgaaagggtacaccaagggaggccccgggcacgaggaacctatccccatggctacatacggatggaaccttgtgaaactgcactccggcaaggatgtctttttcacccctccggagaagtgtgacacactgctctgcgatattggggaatctagccccaatcctaccatcgaggagggacgcacgctgcgggttcttaaaatggtggaaccctggctgagaggcaaccaattttgtattaagatcctcaatccttatatgccctccgtggtcgagaccctggaacagatgcagcgcaaacatggcgggatgctggtgcggaacccgctctctagaaatagcacacacgagatgtactgggtttcctgcggaaccggcaacattgtgagcgccgtcaatatgacatctcgcatgctgcttaaccggttcaccatggctcatagaaagcctacatatgagcgcgacgtggatctgggggccggaacccggcacgttgcggtggaacccgaggtcgccaacctcgacatcatcggccagagaattgaaaatatcaaaaacgagcacaagtccacgtggcattacgatgaagacaatccctataagacatgggcttaccacgggagctatgaggtgaaatcttccggaagcgcctcttccatggtgaacggcgtcgttcgcctgcttaccaagccttgggacgtgattcccatggtgacccaaatcgctatgacagatacgaccccttttggccagcagagagtcttcaaagagaaggtggacacacggaccccgcgcgccaaaagagggacagctcaaattatggaagttaccgccaagtggctgtggggatttctcagccggaataagaaacccagaatctgtacacgggaggagttcacccgcaaggtgagatccaacgcggccatcggcgctgtctttgtggatgagaatcagtggaacagcgccaaagaagctgttgaggacgagcggttctgggatctggtgcatcgcgaaagagagctgcacaagcaggggaaatgcgccacgtgcgtctacaatatgatgggaaagcgggaaaagaaactcggcgagtttgggaaggccaaaggctctcgcgcgatttggtacatgtggctgggagctagattccttgagttcgaggccctgggctttatgaacgaggaccattggttcagccgggaaaattccctctctggggtggagggagaaggcctgcacaaacttgggtatatcctgcgcgatattagcaaaatccctggaggcaacatgtacgccgacgataccgctgggtgggacacaagaattaccgaggatgacctccagaatgaggccaagatcacagatatcatggaacccgagcacgctctgctggccacctccatttttaaactcacgtatcaaaacaaggttgtgcgggtccagcgccctgcgaagtctggcacagtgatggacgtcatcagcagacgggaccagcgcggatccggccaggtggggacctacggactgaatacattcaccaacatggaagttcaacttattagacagatggagtctgaaggcatctttagcccctccgagctggagacgccgaacctcgccaaacgggtgctggattggcttgaaaagcatggggctgagagactgaaacgcatggccattagcggagacgattgtgtcgtgaagcctatcgacgatcggttcgctaccgccctcacagcgctgaatgacatgggcaaagtgagaaaggatatcccccagtgggaaccttctaaggggtggaacgactggcagcaagttcccttttgctcccaccatttccaccagctgattatgaaagatggccgcgagatcgtggtcccttgtcggaatcaggacgaactcgtgggcagagctcgcgttagccagggagctgggtggtctctgcgggagaccgcctgccttggaaagtcctatgctcaaatgtggcagctgatgtactttcacagacgcgatctccggctggccgctaacgccatttgtagcgcggtgcccgtcgactgggtgccgacatccagaaccacatggtctatccatgcccaccatcagtggatgaccacggaggacatgcttagcgtctggaatcgcgtgtggattgaagagaacccttggatggaagataaaacacacgtttccagctgggaggaagtgccctatctgggcaagcgggaggaccaatggtgcgggtctctcatcggactgaccgctagagccacctgggccacaaatattcaggtcgctatcaaccaggtgcggagactgatcggcaatgagaactacctcgattacatgacctccatgaaacgcttcaagaatgaaagcgaccccgagggggccctgtggtga

SEQ ID NO: 18496 - RNA, 9879 nt, synthetic construct
  misc_feature 1..9879: note = derived and/or modified CDS sequence (opt5) from DENV-1__FJ850071__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgctaatggcatccttgcccaggggaagaaaatgattcgcccgcaacccatggagcataagtatagctggaagtcctggggaaaagctaagatcattggcgccgatatccagaacaccacctttatcattgacgggcctgatacacccgaatgtcctgacgatcagcgggcctggaatatctgggaggtggaggactacggattcggcatttttaccacgaacatctggctcaaactgagagattctcacacacagatgtgcgaccaccgcctgatgagcgctgcgattaaggattccaaagccgtccatgctgacatgggctattggatcgaaagcgagaagaatgaaacctggaagctcgcccgggcctctttcatcgaggttaaaacatgtatttggcccaagtcccacaccctgtggagcaacggggtgcttgaatctgagatgatcattccgaaaatctacggaggccctatttcccaacataattatagacccgggtacttcacacagaccgctggaccttggcacctgggcaagctcgagctggattttgacctgtgcgaagggacgaccgtggtcgtggatgagcactgcggataccgcggccccagccttcggacaaccacagttaccggcaaaatcatccatgaatggtgttgcagatcttgtacgctccctcccctgcggttccgcggggaggacggatgctggtatggcatggagattagaccggtgaaggaaaaggaggaaaacctggtccggagcatggtgtccgccgggagcggagaggttgactctttttccctcggcatcctgtgtgtgagcattcttatcgaagaggtcatgagatcccgctggtctcggaaaatgctgatgacagggaccctcgcggtgttctttctgctgattatgggacagcttacatggaatgatctgatcagactctgcattatggttggcgctaacgccagcgaccgcatgggcatggggaccacctacctggccctcatggctacattcaagatgagacctatgtttgccgtgggactgcttttccggaaactgacgtcccgcgaggtcctcctgctgaccatcggcctttctctggtggcgagcgtggaactccccaattccctggaggaactcggggatggactggctatgggcatcatgatgcttaagctgctcacagactttcaaccccaccagctgtggaccacactgctttctctgaccttcattagaacgagcctctccctggattatgcctggaaaacaatggccatggctctcagcatcgtctctctgtttcctctttgtctgtccaccaccagccagaagacaacctggctgccggttctcctggggtctttcggatgcaagccccttacaatgtttctgattacggagaacaaaatctggggccggaagtcctggcctattaacgaaggcatcatggccgtggggatcgtgagcattctcctgtcttccctcctgaaaaatgacgtcccccttgctggacctctgatcgccggcgggatgctgattgcgtgttacgtgatcagcggatccagcgccgatctctctctggagaaggctgccgaggttagctgggaagaggaagctgagcattccggcacctctcacaacattcttgtggaagtccaggacgatgggacaatgaaaatcaaggacgaggagcgcgatgacaccctgacaatcctcctgaaagccaccctcctggccgtgagcggagtttatcccatgtccattcctgctacgcttttcgtgtggtacttctggcaaaagaagaaacagagatctggcgtcctgtgggatacccccagcccgcctgaagtggagcgggcggtcctggacgacggcatctatcgcattctccagagagggctgcttggacggtcccaggtgggcgttggggtgtttcaagatggagtcttccatacaatgtggcacgtgacccgcggcgccgttctgatgtaccaggggaagagactcgaaccctcttgggctagcgtgaaaaaggacctgatctcctacggaggcggctggcggtttcaggggagctggaatacaggagaggaggtccaggtgattgccgtggaacctggcaaaaaccccaagaatgttcaaaccacaccggggacgttcaagacccctgagggagaagtcggcgccatcgctctcgattttaaacccgggacatctggatcccctattgtgaacagagagggcaagatcgtgggcctgtatgggaatggagtcgtgaccaccagcggcacatacgtttctgccatcgcgcaggctaaagcctcccaggaagggccccttcccgagattgaggacgaagtgttcaagaaacgcaacctgacgatcatggatctgcaccctggaagcggcaagacccggagatatctcccggccattgtccgcgaggctatcaagcggaaactgagaacacttattctggcccccacccgcgtggttgcgtccgaaatggctgaggccctcaaggggatgcctatccggtaccaaacaaccgccgtgaaatctgaacatacgggcagagagatcgtcgacctgatgtgccacgctacatttaccatgcgcctgctcagccccgtgcgggttcctaattataacatgattatcatggatgaggcccatttcaccgaccccgcttccattgccgcgagaggatacatcagcacacgggtgggcatgggggaagccgctgccatttttatgaccgctacacctccgggatctgtcgaggccttcccccagtccaatgccgtgatccaggatgaagagcgcgacatccctgaaagaagctggaactctggctatgattggattaccgactttcccgggaagacggtgtggttcgtccctagcatcaaatccggaaatgacattgctaactgtcttcggaagaatggcaagcgcgttatccagctgtctagaaaaacattcgataccgagtaccaaaagacaaaaaacaacgactgggattacgtggtgaccacggacattagcgagatgggggcgaattttcgggccgatagagtcatcgacccccgccggtgcctgaagccggtgattctcaaagatggccctgaaagagttatcctggctggacccatgcccgtgaccgtcgcctccgccgctcagcgccggggcagaatcgggcgcaaccagaataaggagggagaccagtatatttacatgggccaacctcttaacaatgatgaagaccacgcccattggacagaggcgaagatgctgctcgataacatcaatacccccgaggggattatccctgctctgttcgaaccggagcgggaaaaatctgccgccattgacggagagtatagactgcgcggcgaagctagaaagacatttgtggagctcatgcggcgcggggatcttcccgtttggctgagctacaaagtggcctccgagggcttccagtatagcgacagacggtggtgctttgacggagaacgcaacaatcaggtcctggaggaaaacatggatgtggagatctggaccaaggaaggcgagagaaaaaagctccggcctagatggctggacgcgcgcacatactctgatccccttgccctgcgggagttcaaagaatttgctgccgggagacgctccgtcagcggagacctcatcctggagattggcaagctgcctcagcacctcacccttcgggctcaaaatgccctggataacctggtgatgctccacaattccgaacaggggggaaaggcttatagacatgccatggaggaactgcccgacacgatcgagacacttatgctgctcgcgctgattgccgttctgaccggcggcgtgaccctcttctttctttctgggaaaggactgggcaagacaagcatcgggctgctctgtgtgatggcttcctctgccctgctttggatggctagcgtcgagccgcactggattgccgcctccatcatcctggaattctttctcatggttctgctgattcctgagcccgatcggcagcgcacccctcaggacaaccaactcgcttacgtggtgatcggacttctgttcatgattctgacagtcgcggccaatgaaatgggcctcctggagacgaccaaaaaggatcttgggatcggacatgtggctgccgagaaccaccaccatgccacaatgctggacgttgatctcagacccgctagcgcctggaccctgtacgcggtggccacaaccgtcattacgcctatgatgcggcacaccatcgaaaacacaaccgctaatatttctctgacagccatcgctaaccaggccgcgatcctcatgggccttgacaaaggctggcccatttccaagatggatatcggggtgccgctgctggccctcggatgctatagccaggtcaatcctctgacccttacggctgccgtgctgatgctcgttgctcattacgccattatcggccccgggctgcaagctaaggccacacgcgaggcgcagaaaagaaccgccgctggaattatgaagaaccccacagtggacggcatcgtcaccatcgacctggatcctgtggtttatgacgccaaatttgaaaagcagctcgggcagattatgcttctgatcctgtgtacctctcaaattctcctgatgcggacaacgtgggctctttgcgagtccatcaccctggccacaggaccgctcaccacactgtgggaaggcagccccggcaaattctggaataccacgattgccgtgtctatggcgaacatcttccgcgggagctacctggctggagccggcctcgctttttcccttatgaagtctctggggggaggcagacgggggacaggagcccagggcgagaccctgggcgagaagtggaaacgccagctcaatcagctgagcaagtccgaattcaacacctataaaaagagcgggatcatggaggtcgatagatccgaagccaaagagggacttaagcggggcgaaacaaccaagcacgctgtgtctagagggacagccaaactgcgctggtttgtggagcggaatctcgttaagcctgagggaaaagtcattgacctgggctgtgggagaggaggctggagctactattgcgcgggcctgaagaaagtgacggaagtgaaggggtacaccaaaggaggccccgggcatgaggaacctatccccatggccacatacggatggaacctcgtcaagcttcactccggcaaggatgttttctttacccctccggagaaatgtgacacactgctgtgcgatattggggaatctagccccaatcctaccatcgaggagggacgcacgctccgggtgctgaagatggtggaaccctggcttagaggcaaccaattctgtattaaaatcctgaatccttatatgccctccgtcgtggagaccctcgaacagatgcagcgcaagcacggcgggatgctggttcggaacccgctgtctagaaatagcacacatgagatgtactgggtgtcctgcggaaccggcaacattgtcagcgctgtgaatatgacatctcgcatgctcctgaaccggtttaccatggcccacagaaaacctacatatgagcgcgacgttgatcttggggctggaacccggcatgtggccgtcgaacccgaggtggcgaacctggacatcatcggccagagaattgaaaatatcaagaacgagcacaagtccacgtggcactacgatgaagacaatccctataaaacatgggcctaccatgggagctatgaggtgaagccttctggatccgctagctctatggtcaacggcgttgtgcgcctcctgaccaaaccctgggacgtgattcctatggtcacccaaatcgccatgacagatacgaccccgttcggccagcagagagtgtttaaggagaaagttgacacacggaccccccgcgctaagagagggacagcccaaattatggaagtgaccgctaagtggctttggggattcctgtcccggaataaaaagcctagaatctgtacacgggaggaatttacccgcaaagtcagaagcaacgccgcgatcggcgccgtgttcgttgatgagaatcagtggaactccgctaaggaagccgtggaggacgagcggttttgggatctcgtccaccgcgaaagagagctgcataaacaggggaagtgcgctacgtgcgtgtacaatatgatgggaaagcgggaaaaaaagctgggcgagttcgggaaagccaagggcagccgcgccatttggtacatgtggctcggagcgagattcctggaatttgaggctcttggcttcatgaacgaggaccactggttttctcgggaaaatagcctgtccggggttgagggagaaggcctccataaactggggtatatccttcgcgatatttctaagatccccggaggcaacatgtacgccgacgataccgccgggtgggacacaagaattaccgaggatgacctgcagaatgaggctaaaatcacagatatcatggaacctgagcacgccctcctggctaccagcattttcaagctgacgtatcaaaacaaggtggtccgggtgcagcgccccgccaaatccggcacagtcatggacgtgatctctagacgggaccagcgcggaagcggccaggttgggacctacggactcaatacatttaccaacatggaagtgcaactgattagacagatggagtccgaaggcatcttctctccgagcgagcttgagacgcctaacctggcgaagcgggtcctcgattggctggaaaaacacggggccgagagacttaagcgcatggctatttccggagacgattgtgtggtgaaacccatcgacgatcggtttgccaccgctctgacagccctcaatgacatgggcaaggttagaaaggatatccctcagtgggaacccagcaaagggtggaacgactggcagcaagtgcctttctgctctcatcactttcatcagctgattatgaaggatggccgcgagatcgtcgtgccctgtcggaatcaggacgaactggttggaagagcgcgcgtgtcccagggcgccgggtggagcctccgggagaccgcttgcctgggaaaatcttatgcccaaatgtggcagcttatgtacttccacagacgcgatctgcggctcgctgccaacgctatttgttccgccgtcccggtggactgggtccctacaagcagaaccacatggtccatccacgcgcatcaccagtggatgaccacggaggacatgctgtctgtgtggaatcgcgtttggattgaagagaacccctggatggaagataagacacatgtgagctcctgggaggaagtcccctatcttggcaaacgggaggaccaatggtgcgggagcctgatcggactcaccgccagagctacctgggccacaaatattcaggtggccatcaaccaggttcggagactgatcggcaatgagaactacctggattacatgacctctatgaagcgctttaagaatgaatccgaccctgagggggctctctggtga

SEQ ID NO: 18497 - RNA, 9879 nt, synthetic construct
  misc_feature 1..9879: note = derived and/or modified CDS sequence (opt5) from DENV-1__FJ850073__SS-prME
  source 1..9879: mol_type = other RNA
agcgtgaccatgctgctgatgctgcttcccaccgctctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcattacagaggctgaacccgacgatgtggactgttggtgcaatgccaccgatacgtgggtgacctatggaacatgttcccaaaccggcgagcacagacgggacaagcgctctgttgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaggaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagccgccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccgacggcatcctggctcaggggaaaaagatgattcggccgcaacccatggagcacaaatactcctggaagtcttggggaaaggccaaaatcattggcgccgatatccagaacaccacatttatcattgacgggcctgataccctggaatgtcccgacgagcagagagcttggaatatctgggaggtcgaagattatggattcggcatttttacgacaaacatctggcttaagctccgcgacagctacacccagatgtgcgatcaccggctgatgtccgcggccattaaagacagcaaggctgttcatgccgatatgggctattggatcgagtctgagaaaaatgagacatggaagctggccagagcttccttcatcgaagtgaagacctgtatttggcctaaaagccacacactctggtctaacggggtgctggagtccgagatgatcattcccaagatgtacggaggcccggtcagccaacataattatcgccctgggtacttcacccagacggccggaccctggcaccttggcaaactggaactcgactttgatctgtgcgaggggaccacagtggttgtggacgaacactgcggatctcggggccctagcctgagaaccacaaccgtcacgggcaagatcattcatgagtggtgttgccggtcctgtacacttccccctctccgcttcagaggggaggatggatgctggtacggcatggaaatccggcccgtgaaagagaaggaagagaacctggttagaagcatggtgtctgcggggtccggagaagtcgacagcttttccctgggcgtgctctgtgtttctatcatgattgaggaggtgatgcgcagccggtggtccagaaagatgctgatgaccgggacacttgctgtcttcctgctcctgatcatgggacagctgacctggaatgaccttattcgcctgtgcatcatggtgggcgccaacgcctctgataaaatgggcatggggaccacatatctcgctctgatggccacgtttaagatgagaccgatgttcgcggtgggactcctgtttcggcgccttaccagcagagaagtcctgctcctgacaattggcctgtcccttgttgcttctgtggagctgcctaatagcctcgaagaactgggggacggactcgccatgggcatcatgatgctgaaacttctgaccgagttccaaccccaccagctctggacaaccctgctgtcccttacgtttattaagacaaccctgagcctcgattacgcctggaaaaccacagctatggtgctgtctatcgtctccctcttccccctgtgtcttagcaccacatctcagaagacgacctggctgcctgtgctgctcgggtcctttggatgcaagccgctgacaatgttccttatcaccgagaacgagatttggggccggaaaagctggcccctgaacgaaggcatcatggccattgggatcgtttctattctcctgtccagcctcctgaagaatgacgtgcctcttgctggacccctgatcgccggcgggatgctgatcgcgtgttatgtcatttccggaagctctgccgatctcagcctggagaaagctgccgaagtgtcctgggaggaagaggttgagcattctggcacaagccacaacatccttgtggaagtccaggacgatgggaccatgaagattaaagacgaggaacgcgatgacacgctgaccatcctcctgaaggctacactcctggccgtgtccggagtctaccctatgtctattcccgccaccctttttgtgtggtatttctggcagaaaaagaagcagagaagcggcgttctgtgggatacacctagccctcccgaggtggagcgggctgtcctggacgatggcatctaccgcatcctccagagagggctgcttggacggtctcaggtgggcgttggggtgttccaagacggagtctttcataccatgtggcacgtgacacgcggcgcggtgctgatgtatcaggggaaaagactcgaacccagctgggcctccgttaagaaagacctgattagctacggaggcggctggcggttccaggggtcttggaatacgggagaggaagtccaggtgatcgctgtggagcccggcaagaaccctaaaaatgtccaaaccacacccgggacctttaagaccccggaaggagaggtgggcgccattgccctcgatttcaagcctgggacatccggaagccccatcgttaacagagagggcaaaattgtgggcctgtacgggaatggagtcgtgacgacctctggcacatatgtttccgctatcgcccaggcgaaggctagccaggaagggcctcttcccgagattgaagacgaggtgtttaaaaagcgcaacctgaccatcatggatctgcaccccggatccggcaaaacacggagatacctccctgccatcgtccgcgaagccattaagcggaagctgagaacccttatcctggctccgacgcgcgtggttgcctctgagatggcggaggctctcaaagggatgcccattcggtatcaaacaaccgccgtgaagtccgaacataccggcagagagatcgtcgacctgatgtgccacgccacattcaccatgcgcctgctctcccctgtgcgggtgcccaattacaacatgattatcatggatgaagctcattttacagaccctgccagcatcgctgccagaggatatatttctacccgggtcggcatgggggaggcggccgctatcttcatgacggccacaccccctggatccgttgaggcttttccgcagagcaatgccgtgattcaggatgaggagcgcgacatccccgaaagatcttggaacagcggctacgattggattaccgacttccctgggaaaacagtgtggtttgtcccctccatcaagtctggaaatgatatcgccaactgtcttcggaaaaatggcaagcgcgtgattcagctgagcagaaagaccttcgacacggagtatcagaaaaccaagaacaacgactgggattacgttgtgacaaccgacatctccgaaatgggggctaatttccgggcggatagagtcattgaccctcgccggtgcctgaaacccgtgatcctcaaggatggcccggagagagttattctggccggacctatgcccgtgacagtcgcttctgccgcccagcgccggggcagaatcgggcgcaaccagaataaagagggagaccagtacgtgtatatgggccaaccccttaacaatgatgaagaccacgctcattggaccgaggccaagatgctgctcgataacattaatacacctgaagggatcatccccgcgctgtttgagcctgaacgggaaaagagcgctgccattgacggagagtacagactgcgcggcgaagccagaaaaaccttcgtcgagctcatgcggcgcggggatcttccggtgtggctgtcctataaggttgctagcgaaggctttcagtactctgacagacggtggtgcttcgatggagagcgcaacaatcaggtgctggaagagaacatggacgtggagatctggacgaaagaaggcgagagaaagaaactccggcccagatggctggacgcccgcacatattccgatcctcttgcgctgcgggaatttaaggagttcgccgctgggagacgcagcgtctccggagacctcattctggaaatcggcaaactgccccagcacctcacccttcgggcccaaaatgctctggataacctggttatgctccacaattctgagcaagggggaaaggcctacagacatgctatggaggaactgcctgacaccattgagacacttatgctgctcgccctgatggcggtgctgaccggcggcgtgacactctttttccttagcgggaagggactgggcaaaacgtccatcgggctgctctgtgtcatggcctctagcgctctgctttggatggcctccgtggaaccccactggatcgctgccagcattatcctggagtttttcctcatggttctgctgattccggagcctgatcggcagcgcacaccccaggacaaccaactcgcctatgtggtcatcggacttctgtttatgattctgacagtggctgcgaatgaaatgggcctcctggagaccacaaagaaagatcttgggatcggacatgtcgccgctgaaaaccaccagcacgccaccatgctggacgtggatctccatcctgcctctgcttggacgctgtacgccgttgcgaccacagtgatcacccccatgatgagacacacaattgagaacaccacggccaatatctccctgacagctattgccaaccaggctgccatcctcatgggccttgacaagggctggcctattagcaaaatggatctgggggtccccctgctcgcgctgggatgctactctcaagtgaatccgcttaccctgacagccgctgttctcatgctggtggcccattatgctatcattggccctgggctgcaggccaaggctacccgggaagcccagaagcgcaccgcggccggaatcatgaaaaaccccacagtcgacggcatcgtggctattgatctcgaccccgtggtttacgacgccaagttcgagaaacagcttgggcaaatcatgctgctgattctctgtacgtcccagatcctgcttatgagaaccacatgggctctgtgcgagagcattaccctcgccacaggacctctgaccacgctgtgggaaggctctccgggcaagttttggaatacaaccatcgccgtcagcatggcgaacatcttccgggggtcctatctcgctggagccggccttgctttctctctgatgaaaagcctcgggggaggccgcagagggaccggagcccagggcgagacactcggcgaaaagtggaagcggcagctgaatcaactttccaaaagcgagtttaacacctacaagcgctccgggattatggaagtggatagatctgaggccaaagagggactgaagcggggcgaaacaacgaaacacgctgtgagcagagggaccgccaagctccgctggttcgtcgagcggaatctggttaagcccgaaggaaaagtgatcgacctgggctgtgggagaggaggctggtcctattactgcgcgggcctcaagaaagtgacagaggtcaaggggtataccaaaggaggccctgggcatgaagaacccattcctatggccacatacggatggaaccttgtgaagctgcactctggcaaagatgtctttttcatgccccctgagaagtgtgacaccctgctctgcgatatcggggaaagctccccgaatcccacgattgaggaaggacgcaccctgcgggtgcttaagatggtcgagccttggctgagaggcaaccagttttgtatcaaaatcctcaatccctacatgccttctgtggttgagacactggaacagatgcagcgcaagcacggcgggatgctggtgcggaaccccctcagcagaaattccacccatgagatgtattgggtcagctgcggaacaggcaacattgtgtctgctgtgaatatgacctcccgcatgctgcttaaccggttcacaatggcccacagaaaaccgacctacgaacgcgacgtcgatctgggggctggaacgcggcatgttgccgtggagcctgaagtggcgaacctcgacatcattggccaaagaatcgagaatattaagaacgagcacaaaagcacatggcactatgatgaagacaatccctacaagacctgggcctatcatgggtcttacgaggtcaagccctccggaagcgcttcttccatggtgaacggcgttgtgcgcctgcttaccaaaccttgggatgtcatccccatggtgacacagattgccatgacggacaccacaccttttggccagcaaagagttttcaaggaaaaagtggacacccggacaccgcgcgctaagagagggaccgcccagatcatggaggtcacagctaaatggctgtggggatttctcagccggaataagaagcccagaatctgtacccgggaagagttcacgcgcaaagtgagatccaacgccgcgattggcgccgtttttgtggatgagaatcagtggaacagcgctaaggaagccgtcgaggacgaacggttctgggatctggtgcaccgcgagagagaactgcataaacaggggaagtgcgctacctgcgtctataatatgatgggaaaacgggagaagaagctcggcgagtttgggaaagccaagggctctcgcgccatctggtacatgtggctgggagcgagattccttgagttcgaggctctgggctttatgaacgaagaccactggttcagccgggaaaattccctctctggggtggagggagaaggcctgcataaacttgggtacattctgcgcgatatcagcaagattcctggaggcaacatgtatgccgacgatacagccgggtgggacaccagaatcacagaggatgacctccggaatgaagctaaaatcaccgatattatggagcccgaacacgccctgctggctacgtccatctttaagctcacataccaaaacaaagttgtgcgcgtccagagacctgccaagaatggcaccgtgatggacgtgatttctcggcgcgatcagagaggaagcggccaggttgggacatatggactgaacaccttcacgaacatggaggtgcaacttatccggcagatggagtccgaaggcatctttttctctagcgagctggaatcccccaatctcgcggagagagtcctggactggcttgaaaagcacggggccgagcgcctgaaacggatggctatcagcggagacgattgtgtggttaagccgatcgacgatagatttgccaccgctctcattgccctgaacgacatgggcaaagtgcgcaaggatatccctcagtgggagccctctaaagggtggaatgactggcagcaagtccctttctgctcccatcactttcatcagctgattatgaaggatggccgggaaatcgtggtcccctgtagaaaccaggacgagctcgtgggacgcgcgcgggttagccagggcgccgggtggtctctgagagaaacagcttgccttggaaagtcctacgcccaaatgtggcagctgatgtatttccaccgccgggatctcagactggctgccaatgctatttgtagcgccgtgcctgtcgactgggtgcccacctcccgcacaacctggtctatccacgcgcatcaccagtggatgacaaccgaggatatgcttagcgtttggaaccgggtgtggatcgaagagaatccgtggatggaggacaaaacgcatgtctccagctgggaagaggtgccttacctgggcaagagagaagaccaatggtgcgggtctctcattggactgacagcccgggctacctgggccaccaacatccaggtggccattaatcaggttagacgcctgatcggcaacgggaattatctcgattacatgacatccatgaaacggtttaagaacgagagcgaccccgagggcgctctgtggtga

SEQ ID NO: 18498 - RNA, 9879 nt, synthetic construct
  misc_feature 1..9879: note = derived and/or modified CDS sequence (opt5) from DENV-1__FJ850075__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgctaatggcatccttgcccaggggaagaaaatgattcgcccgcaacccatggagcataagtatagctggaagtcctggggaaaagctaagatcattggcgccgatatccagaacaccacctttatcattgacgggcctgatacacccgaatgtcctgacgatcagcgggcctggaatatctgggaggtggaggactacggattcggcatttttaccacgaacatctggctcaaactgagagattctcacacacagatgtgcgaccaccgcctgatgagcgctgcgattaaggattccaaagccgtccatgctgacatgggctattggatcgaaagcgagaagaatgaaacctggaagctcgcccgggcctctttcatcgaggttaaaacatgtatttggcccaagtcccacaccctgtggagcaacggggtgcttgaatctgagatgatcattccgaaaatctacggaggccctatttcccaacataattatagacccgggtacttcacacagaccgctggaccttggcacctgggcaagctcgagctggattttgacctgtgcgaagggacgaccgtggtcgtggatgagcactgcggataccgcggccccagccttcggacaaccacagttaccggcaaaacgatccatgaatggtgttgcagatcttgtacactccctcccctgcggttccgcggggaggacggatgctggtatggcatggagatcagaccggtgaaggaaaaggaggaaaacctggtccggagcatggtgtccgccgggagcggagaggttgactctttttccctcggcattctgtgtgtgagcatccttattgaagaggtcatgagatcccgctggtctcggaaaatgctgatgaccgggacactcgcggtgttcctgctgcttatcatgggacagctgacctggaatgatctcattagactgtgcatcatggttggcgctaacgccagcgaccgcatgggcatggggaccacatacctcgccctgatggctacgtttaagatgagacctatgttcgccgtgggacttctgtttcggcgcctcacctccagagaggtcctgctgcttacaattggcctgtctctcgtggcgagcgtggaactgcccaattccctcgaggaactgggggatggacttgctatgggcatcatgatgctgaaactcctgaccgacttccaaccccaccagctgtggacaacccttctgtctctcacgtttatccggacaagcctgtccctcgattatgcctggaagaccatggccatggctctgagcattgtctctcttttccctctgtgtctgtccaccacaagccagaaaaccacatggctcccggttctgcttgggtcttttggatgcaagcccctgacgatgttcctcatcaccgagaacaagatttggggccgcaaatcctggcctatcaacgaaggcattatggccgtggggatcgtgagcatcctgctctcttccctgcttaagaatgacgtccccctggctggacctctgattgccggcgggatgctcatcgcgtgttacgtgattagcggatccagcgccgatctgtctcttgagaaagctgccgaggttagctgggaagaggaagctgagcattccggcacatctcacaacatcctggtggaagtccaggacgatgggaccatgaagattaaagacgaggagagagatgacacactcaccatcctgctcaaggccacgctgcttgccgtgagcggagtttatcccatgtccatccctgctaccctgtttgtgtggtacttctggcaaaaaaagaagcagcggtctggcgtcctgtgggatacacccagcccgcctgaagtggagcgcgcggtcctcgacgacggcatttatagaatcctgcagcgggggcttctgggacgctcccaggtgggcgttggggtgttccaagatggagtctttcataccatgtggcacgtgacaagaggcgccgttctcatgtaccaggggaaacggctggaaccctcttgggctagcgtgaagaaagacctcatttcctacggaggcggctggagattccaggggagctggaataccggagaggaggtccaggtgatcgccgtggaacctggcaagaaccccaaaaatgttcaaacaacgccggggacctttaagacacctgagggagaagtcggcgccattgctctggatttcaagcccgggacctctggatcccctatcgtgaaccgcgagggcaaaattgtgggcctttatgggaatggagtcgtgaccacaagcggcacgtacgtttctgccatcgcgcaggctaaggcctcccaggaagggcccctgcccgagatcgaggacgaagtgtttaaaaagcggaacctgaccattatggatctccaccctggaagcggcaaaacaagacgctatctgccggccatcgtccgggaggctattaagagaaagcttcgcaccctgatcctcgcccccacacgggtggttgcgtccgaaatggctgaggccctgaaagggatgcctattagataccaaaccacggccgtgaagtctgaacatacaggccgcgagatcgtcgacctgatgtgccacgctaccttcaccatgcggctccttagccccgtgagagttcctaattataacatgatcattatggatgaggcccattttacagaccccgcttccatcgccgcgcggggatacattagcacccgcgtgggcatgggggaagccgctgccatcttcatgacagctacccctccgggatctgtcgaggcctttccccagtccaatgccgtgattcaggatgaagagagagacatccctgaacggagctggaactctggctatgattggatcacggacttccccgggaaaacagtgtggtttgtccctagcattaagtccggaaatgacatcgctaactgtctgcgcaaaaatggcaagagagttattcagctgtctcggaagaccttcgatacagagtaccaaaaaaccaagaacaacgactgggattacgtggtgacgaccgacatcagcgagatgggggcgaatttcagagccgatcgcgtcattgacccccggagatgcctcaaaccggtgatcctgaaggatggccctgaacgcgttattcttgctggacccatgcccgtgacagtcgcctccgccgctcagcggagaggccgcatcgggcggaaccagaataaagagggagaccagtatatctacatgggccaacctctgaacaatgatgaagaccacgcccattggaccgaggcgaagatgctcctggataacattaatacacccgaggggatcattcctgctctgtttgaaccggagagagaaaagtctgccgccatcgacggagagtatcgcctcagaggcgaagctcggaaaaccttcgtggagcttatgcgcagaggggatctgcccgtttggctgagctacaaggtggcctccgagggctttcagtatagcgaccggcgctggtgcttcgacggagaaagaaacaatcaggtcctcgaggaaaacatggatgtggagatttggacaaaagaaggcgagcggaagaaactgagacctcgctggcttgacgcgcggacctactctgatcccctggccctcagagagtttaaggaattcgctgccgggcgccggtccgtcagcggagacctgatcctggagatcggcaaactccctcagcaccttacgctgagagctcaaaatgccctggataacctcgtgatgctgcacaattccgaacaggggggaaaggcttatcggcatgccatggaggaacttcccgacacaattgagaccctgatgctcctggcgctgatcgccgttctcaccggcggcgtgacactttttttcctgtctgggaagggactgggcaaaaccagcattgggctcctgtgtgtgatggcttcctctgcccttctgtggatggctagcgtcgagccgcactggatcgccgcctccattatcctcgaatttttcctgatggttctgctcatccctgagcccgatcgccagagaacacctcaggacaaccaacttgcttacgtggtgattggactgctgtttatgatcctcacggtcgcggccaatgaaatgggcctgcttgagaccacaaagaaagatctggggattggacatgtggctgccgagaaccaccaccatgccaccatgctcgacgttgatctgcggcccgctagcgcctggacactgtacgcggtggccaccacggtcatcacccctatgatgcgccacacaattgaaaacaccacagctaatatctctctcaccgccattgctaaccaggccgcgatccttatgggcctggacaagggctggcccatctccaaaatggatattggggtgccgctgctcgccctgggatgctatagccaggtcaatcctcttacgctgacagctgccgtgctcatgctggttgctcattacgccatcattggccccgggctgcaagctaaggccaccagagaggcgcagaagcggacagccgctggaatcatgaaaaaccccaccgtggacggcattgtcaccatcgacctcgatcctgtggtttatgacgccaagttcgaaaaacagcttgggcagatcatgctgctgattctctgtacatctcaaatcctgcttatgcgcacgacctgggctctgtgcgagtccattacactcgccaccggaccgctgacaaccctgtgggaaggcagccccggcaagttttggaatacgacaatcgccgtgtctatggcgaacattttcagagggagctacctcgctggagccggccttgctttctccctgatgaaatctctggggggaggccggcgcgggaccggagcccagggcgagaccctcggcgagaagtggaagagacagctgaatcagcttagcaaatccgaatttaacacatataagaaaagcgggatcatggaggtcgatcggtccgaagccaaggagggactgaaaagaggcgaaaccacaaagcacgctgtgtctcgcgggacggccaagctccggtggttcgtggagagaaatctggttaaacctgagggaaaggtcatcgacctgggctgtgggcgcggaggctggagctactattgcgcgggcctcaaaaaggtgaccgaagtgaaagggtacacaaagggaggccccgggcatgaggaacctattcccatggccacctacggatggaaccttgtcaaactgcactccggcaaggatgtttttttcacacctccggagaagtgtgacaccctgctctgcgatatcggggaatctagccccaatcctacgattgaggagggacggaccctgagagtgcttaaaatggtggaaccctggctgcgcggcaaccaattttgtatcaagattctcaatccttatatgccctccgtcgtggagacactggaacagatgcagcggaaacacggcgggatgctggttagaaacccgctctctcgcaatagcacccatgagatgtactgggtgtcctgcggaacaggcaacatcgtcagcgctgtgaatatgacctctcggatgctgcttaacagattcacaatggcccaccgcaagcctacctatgagcgggacgttgatctgggggctggaacgagacatgtggccgtcgaacccgaggtggcgaacctcgacattatcggccagcgcatcgaaaatattaaaaacgagcacaagtccacatggcactacgatgaagacaatccctataagacctgggcctaccatgggagctatgaggtgaaaccttctggatccgctagctctatggtcaacggcgttgtgagactgcttaccaagccctgggacgtgatccctatggtcacacaaattgccatgacggataccacaccgtttggccagcagcgggtgttcaaagagaaggttgacacccgcacacccagagctaaacgggggaccgcccaaatcatggaagtgacagctaagtggctgtggggatttctctccagaaataagaaacctcggatttgtacccgcgaggaattcacgagaaaggtccggagcaacgccgcgatcggcgccgtgtttgttgatgagaatcagtggaactccgctaaagaagccgtggaggacgagcgcttctgggatctggtccacagagaacgggagctgcataagcaggggaaatgcgctacctgcgtgtacaatatgatgggaaagcgcgaaaagaaactcggcgagtttgggaaggccaaaggcagcagagccatctggtacatgtggctgggagcgcggttccttgaattcgaggctctgggctttatgaacgaggaccactggttctctcgcgaaaatagcctctccggggttgagggagaaggcctgcataagcttgggtatattctgagagatatctctaaaattcccggaggcaacatgtacgccgacgatacagccgggtgggacacccggatcacagaggatgacctccagaatgaggctaagattaccgatatcatggaacctgagcacgccctgctggctacgagcatctttaaactcacatatcaaaacaaggtggtccgcgtgcagagacccgccaagtccggcaccgtcatggacgtgatttctcggcgcgaccagagaggaagcggccaggttgggacatacggactgaataccttcacgaacatggaagtgcaacttatccggcagatggagtccgaaggcattttttctccgagcgagctggagacccctaacctcgcgaaaagagtcctggattggcttgaaaagcacggggtggagcgcctgaaacggatggccatctccggagacgattgtgtggttaagcccattgacgatagattcgctacagccctcaccgctctgaatgacatgggcaaagtgcgcaaggatatccctcagtgggaacccagcaaggggtggaacgactggcagcaagtccctttttgctctcatcacttccatcagctgatcatgaaagatggccgggagattgtggttccctgtagaaatcaggacgaactcgtgggacgcgcccgggtctcccagggcgcggggtggagcctgagagagacagcctgccttggaaagtcttatgctcaaatgtggcagctgatgtactttcaccgccgggatctcagactggccgctaacgccatctgttccgctgtgccggtcgactgggtgcctaccagccgcacaacctggtccattcacgcccatcaccagtggatgacgacagaggacatgctttctgtttggaatcgggtgtggatcgaagagaacccctggatggaagataaaacccatgtcagctcctgggaggaagtgccctatctgggcaagagagaggaccaatggtgcgggagcctcattggactgaccgcgcgggccacatgggctaccaatatccaggttgccattaaccaggtgagacgcctgatcggcaatgagaactacctcgattacatgacatctatgaaacggttcaagaatgaatccgaccctgagggggccctgtggtga

SEQ ID NO: 18499 - RNA, 9879 nt, synthetic construct
  misc_feature 1..9879: note = derived and/or modified CDS sequence (opt5) from DENV-1__FJ850077__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggtggaacccgacgatgtcgactgttggtgcaatgcgaccgatacgtgggtgacctatggaacatgttcccaaaccggcgagcacagacgggacaagcgctctgttgctctggcccctcatgtggggctcggactggagacaagaaccgaaacgtggatgagctccgagggcgcctggaaacaggtccagaaggtggaaacatgggctcttcggcaccccggcttcaccgttattgccctgtttctcgctcatgccatcgggacatctattacccagaagggaatcatcttcattctgcttatgctggtgacccctagcatggcgatgcgctgcgtcggcatcgggaacagagattttgtggagggactctccggcgccacatgggtggacgtcgttctggagcacgggagctgtgtgacgaccatggctaaaaataagcccacactggatattgaactcctgaaaaccgaggtgacaaaccctgccgtccttcggaagctgtgcatcgaagctaaaatttctaataccacgacagactcccgctgtccgacccaaggagaggccaccctcgtggaagagcaggatgcgaacttcgtttgcagacggacatttgtggaccgcggctggggcaatgggtgtggactgttcggcaaggggagccttctgacctgcgccaagtttaaatgcgtcacaaagctcgagggaaaaatcgtgcagtacgaaaacctgaagtattctgttattgtgacggtccacaccggcgatcagcatcaagtggggaatgagacaaccgaacacggaacaatcgctaccatcacgccccaggcccctacctccgagattcagctgacagactacggcgctctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggttacattcaagaccgcccacgctaagaaacaggaagtggtcgtgctcggatctcaagagggcgcgatgcacaccgccctgacaggggctacggaaatccagaccagcggaacaaccacaatttttgccggccatcttaagtgccgcctgaaaatggacaagctcaccctgaaagggatgtcctatgttatgtgtacgggcagcttcaagctggagaaggaagtggccgagacacagcacggaaccgtccttgtgcaggtgaaatacgagggcaccgatgctccgtgcaagatccctttcctcacacaagacgaaaaaggggttacccagaacggaagactgattacagccaatcccatcgtcacggataaggagaaacctgtgaacatcgaaaccgagcccccctttggcgagtcttatattgtggtcggggcgggagaaaaggctctgaagctctcctggttcaaaaagggcagctctatcgggaaaatgtttgaggccacagcccggggcgctagacgcatggccattctgggagacaccgcttgggatttcggcagcatcgggggactttttacatccgtgggcaagctgattcatcaggttttcgggaccgcctacggagtgctcttttctggcgtcagctggacgatgaaaatcgggatcggcattctgctgacctggcttggactcaattcccggagcacatctctgtccatgacctgtatcgcggtgggcatggttacactgtacctcggggtgatggtccaggccgacagcggatgcgtgattaactggaagggcagagaactgaagtgtgggtctggaatcttcgttaccaacgaggtgcacacatggaccgaacaatataaatttcaggctgattcccctaagcgccttagcgccgctattggcaaagcctgggaggagggggtctgcggcatccggtccgcgacgagactggaaaatattatgtggaagcagatctctaacgagctcaattacatcctgctggaaaacgacatgaaattcacagtggtggtcggagacgccaatggcattcttacccaggggaagaaaatgatccgcccgcaacccatggagcataagtatagctggaagtcctggggaaaagctaagattatcggcgccgatattcagaacaccacatttatcatcgacgggcctgatacccccgaatgtcctgacgatcagcgggcttggaatatttgggaggttgaggactacggattcggcatctttacgacaaacatttggctcaaactgagagattcttatacccagatgtgcgaccaccgcctgatgagcgccgccatcaaggattccaaagctgtgcacgcggacatgggctactggattgaaagcgagaagaatgaaacatggaagctcgcccgggcttctttcatcgaggtgaaaacctgtatctggcccaagtcccatacactgtggagcaacggggtccttgaatctgagatgattatcccgaaaatttatggaggccctacctcccaacacaattacagacccgggtacttcacgcagaccgccggaccttggcatctgggcaagctcgagctggattttgacctgtgcgaagggacaaccgtggttgtggatgagcactgcggatatcgcggccccagccttcggacaaccacggtcacaggcaaaatcattcacgaatggtgttgcagatcttgtaccctccctcccctgcggttccgcggggaggacggatgctggtacggcatggagatcagaccggtgaaggaaaaggaggaaaacctggttcggagcatggtgtccgccgggagcggagaggtcgactctttttccctcggcatcctgtgtgtgagcattcttatcgaagaggttatgagatcccgctggtctcggaaaatgctgatgacagggaccctcgctgtgttcctgctgcttattatgggacagctgacctggaatgatctcatcagactgtgcattatggtcggcgccaacgcgagcgaccgcatgggcatggggacaacgtatctcgctctgatggccacctttaagatgagacctatgttcgccgtgggacttctgtttcggaaactcacatcccgcgaggtgctgctgcttaccatcggcctgtctctcgtcgctagcgttgaactgcccaattccctcgaggaactgggggatggacttgccatgggcattatgatgctgaagctcctgacagacttccaaccccatcagctgtggaccacgcttctgtctctcacatttatcagaaccagcctgtccctcgattacgcgtggaaaaccatggctatggccctgagcatcgtgtctcttttccctctgtgtctgtccacaaccagccagaagacaacgtggctcccggtgctgcttgggtcttttggatgcaagcccctgaccatgttcctcattacagagaaccggatctggggccgcaaatcctggcctattaacgaaggcgtcatggccgtggggatcgttagcattctgctctcttccctgcttaagaatgacgtgcccctggctggacctctgatcgccggcgggatgctcatcgcttgttatgtcattagcggatccagcgccgatctgtctcttgagaaagcggccgaggtgagctgggaagaggaagctgagcactccggcacctctcataacatcctggttgaagtgcaggacgatgggacaatgaagattaaagacgaggagagagatgacaccctcacgatcctgctcaaggccaccctgcttgctgtcagcggagtgtaccccatgtccattcctgccacactgtttgtctggtatttctggcaaaaaaagaagcagcggtctggcgtgctgtgggatacccccagcccgcctgaagttgagcgcgccgtgctcgacgacggcatctacagaatcctgcagcgggggcttctgggacgctcccaggtcggcgtgggggttttccaagatggagtgtttcacacaatgtggcatgtcaccagaggcgctgtgctcatgtaccaggggaaacggctggaaccctcttgggcgagcgtgaagaaagacctcatttcctatggaggcggctggagattccaggggagctggaatacaggagaggaggttcaggtcatcgccgtggaacctggcaagaaccccaaaaatgtgcaaacgaccccggggacatttaagacccctgagggagaagtcggcgctattgccctggatttcaagcccgggacctctggatcccctatcgtgaaccgcgagggcaaaattgttggcctttacgggaatggagtggtcacaacgagcggcacctatgtgtctgccatcgctcaggccaaggcgtcccaggaagggcccctgcccgagattgaggacgaagtttttaaaaagcggaacctgacaatcatggatctccaccctggaagcggcaaaaccagacgctacctgccggctatcgtgcgggaggccattaagagaaagcttcgcacactgatcctcgcccccacccgggtcgtggcttccgaaatggccgaggcgctgaaagggatgcctattagatatcaaacgacagctgttaagtctgaacacaccggccgcgagatcgtggacctgatgtgccatgccaccttcacaatgcggctccttagccccgtcagagtgcctaattacaacatgattatcatggatgaggcccactttaccgaccccgcttccatcgccgctcggggatatattagcacacgcgtgggcatgggggaagccgcggccatcttcatgaccgctacgcctccgggatctgtcgaggcctttccccagtccaatgctgttattcaggatgaagagagagacatccctgaacggagctggaactctggctacgattggattacagacttccccgggaaaaccgtgtggtttgtgcctagcatcaagtccggaaatgacatcgccaactgtctgcgcaaaaatggcaagagagtcattcagctgtctcggaagacattcgataccgagtaccaaaaaacgaagaacaacgactgggattatgtggttaccacagacatcagcgagatgggggccaatttcagagctgatcgcgtgattgacccccggagatgcctcaaaccggtcatcctgaaggatggccctgaacgcgtgattcttgcgggacccatgcccgttaccgtggcctccgctgcccagcggagaggccgcatcgggcggaaccagaataaagagggagaccagtacatttatatgggccaacctctgaacaatgatgaagaccatgcccactggacagaggctaagatgctcctggataacatcaatacccccgaggggatcattcctgccctgtttgaaccggagagagaaaagtctgcggctatcgacggagagtaccgcctcagaggcgaagcccggaaaacattcgtcgagcttatgcgcagaggggatctgcccgtgtggctgagctataaggtcgcctccgagggctttcagtacagcgaccggcgctggtgcttcgacggagaaagaaacaatcaggtgctcgaggaaaacatggatgttgagatttggaccaaagaaggcgagcggaagaaactgagacctcgctggcttgacgctcggacgtattctgatcccctggccctcagagagtttaaggaattcgcggccgggcgccggtccgtgagcggagacctgatcctggagattggcaaactccctcagcatcttacactgagagctcaaaatgccctggataacctcgtgatgctgcacaattccgaacaggggggaaaggcttaccggcacgccatggaggaacttcccgacaccatcgagaccctgatgctcctggctctgatcgccgtcctcacaggcggcgttaccctttttttcctgtctgggaagggactgggcaaaacaagcattgggctcctgtgtgtgatggcgtcctctgcccttctgtggatggctagcgtggagccgcattggatcgccgcttccattatcctcgaatttttcctgatggtcctgctcattcctgagcccgatcgccagagaacgcctcaggacaaccaacttgcctacgtggttatcggactgctgtttatgatcctcaccgtggccgctaatgaaatgggcctgcttgagacaaccaagaaagatctggggattggacacgtcgcggccgagaaccatcaccacgctacaatgctcgacgtggatctgcggcccgccagcgcctggaccctgtatgctgtcgccacgaccgtgatcacacctatgatgcgccataccattgaaaacacaaccgcgaatatctctctcacggccattgctaaccaggccgctatccttatgggcctggacaagggctggcccatttccaaaatggatatcggggttccgctgctcgccctgggatgctacagccaggtgaatcctcttacactgaccgcgacagtcctcatgctggtggcccactatgctatcattggccccgggctgcaagccaaggctaccagagaggcccagaagcggaccgctgccggaatcatgaaaaaccccacagttgacggcattgtgacgatcgacctcgatcctgtcgtgtacgacgcgaagttcgaaaaacagcttgggcagattatgctgctgatcctctgtacctctcaaatcctgcttatgcgcacaacctgggccctgtgcgagtccattacactcgctaccggaccgctgacgacactgtgggaaggcagccccggcaagttttggaataccaccatcgccgtgtctatggctaacattttcagagggagctatctcgccggagccggccttgcgttctccctgatgaaatctctggggggaggccggcgcgggacaggagctcagggcgagaccctcggcgagaagtggaagagacagctgaatcagcttagcaaatccgaatttaacacatacaagaaaagcgggatcatggaggttgatcggtccgaagccaaggagggactgaaaagaggcgaaacgaccaagcatgctgtctctcgcgggacagccaagctccggtggttcgtggagagaaatctggtgaaacctgagggaaaggtcattgacctgggctgtgggcgcggaggctggagctattactgcgccggcctcaaaaaggttaccgaagtgaaagggtacacaaagggaggccccgggcacgaggaacctatccccatggctacctatggatggaaccttgtgaaactgcattccggcaaggatgtctttttcacgcctccggagaagtgtgacaccctgctctgcgatatcggggaatctagccccaatcctacaattgaggagggacggaccctgagagtgcttaaaatggttgaaccctggctgcgcggcaaccaattttgtatcaagattctcaatccttacatgccctccgtggtcgagacactggaacagatgcagcggaaacacggcgggatgctggtgagaaacccgctctctcgcaatagcacccacgagatgtattgggtttcctgcggaacaggcaacatcgtgagcgccgtcaatatgacctctcggatgctgcttaacagattcacgatggcgcatcgcaagcctacatacgagcgggacgtggatctgggggccggaaccagacacgtggctgtcgaacccgaggttgccaacctcgacattatcggccagcgcattgaaaatatcaaaaacgagcataagtccacctggcactatgatgaagacaatccctacaagacatgggcttatcacgggagctacgaggtgaaaccttctggatccgccagctctatggtgaacggcgtcgtgagactgcttacgaagccctgggacgttatccctatggtgacccaaattgcgatgacagataccacaccgtttggccagcagcgggtcttcaaagagaaggtggacacccgcacacccagagccaaacgggggaccgctcaaatcatggaagttacggccaagtggctgtggggatttctctccagaaataagaaacctcggatttgtacccgcgaggaattcacaagaaaggtgcggagcaacgctgccatcggcgctgtctttgtggatgagaatcagtggaactccgccaaagaagcggttgaggacgagcgcttctgggatctggtgcatagagaacgggagctgcacaagcaggggaaatgcgccacctgcgtctacaatatgatgggaaagcgcgaaaagaaactcggcgagtttgggaaggctaaaggcagcagagccatttggtatatgtggctgggagctcggttccttgaattcgaggccctgggctttatgaacgaggaccattggttctctcgcgaaaatagcctctccggggtggagggagaaggcctgcacaagcttgggtacatcctgagagatatctctaaaattcccggaggcaacatgtatgccgacgatacagcggggtgggacacccggatcacggaggatgacctccagaatgaggctaagattacagatatcatggaacctgagcatgccctgctggccaccagcatttttaaactcacataccaaaacaaggtcgtgcgcgttcagagacccgctaagtccggcaccgtgatggacgtcatctctcggcgcgaccagagaggaagcggccaggtggggacgtatggactgaataccttcacaaacatggaagtgcaacttatccggcagatggagtccgaaggcattttttctccgagcgagctggagacccctaacctcgccaaaagagttctggattggcttgaaaagcacggggctgagcgcctgaaacggatggccatctccggagacgattgtgtggtcaagcccattgacgatagattcgcgacagccctcaccgctctgaatgacatgggcaaagtgcgcaaggatatccctcagtgggaacccagcaaggggtggaacgactggcagcaagttcctttttgctctcaccatttccaccagctgattatgaaagatggccgggacatcgtggtcccctgtagaaatcaggatgagctcgtgggacgcgcccgggtctcccagggcgctgggtggagcctgagagaaacagcctgccttggaaagtcttacgcgcaaatgtggcagctgatgtattttcatcgccgggacctcagactggccgctaacgccatctgttccgctgtgccggttgactgggtgcctaccagccgcacgacatggtccattcacgcccaccatcagtggatgaccaccgaggatatgctttctgtctggaatcgggtgtggatcgaggaaaacccctggatggaggacaaaacacacgttagctcctgggaagaggtgccctacctgggcaagagagaagatcaatggtgcgggagcctcattggactgaccgctcgggccacatgggcgacgaatatccaggtcgccattaaccaggtgagacgcctgatcggcaatgagaactacctcgactatatgacctctatgaaacggttcaagaatgagtccgatcctgaaggggctctgtggtga

SEQ ID NO: 18500 - RNA, 9879 nt, synthetic construct
  misc_feature 1..9879: note = derived and/or modified CDS sequence (opt5) from DENV-1__FJ850081__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgctaatggcatccttgcccaggggaagaaaatgattcgcccgcaacccatggagcataagtatagctggaagtcctggggaaaagctaagatcattggcgccgatatccagaacaccacctttatcattgacgggcctgatacacccgaatgtcctgacgatcagcgggcctggaatatctgggaggtggaggactacggattcggcatttttaccacgaacatctggctcaaactgagagattctcacacacagatgtgcgaccaccgcctgatgagcgctgcgattaaggattccaaagccgtccatgctgacatgggctattggatcgaaagcgagaagaatgaaacctggaagctcgcccgggcctctttcatcgaggttaaaacatgtatttggcccaagtcccacaccctgtggagcaacggggtgcttgaatctgagatgatcattccgaaaatctacggaggccctatttcccaacataattatagacccgggtacttcacacagaccgctggaccttggcacctgggcaagctcgagctggattttgacctgtgcgaagggacgaccgtggtcgtggatgagcactgcggataccgcggccccagccttcggacaaccacagttaccggcaaaatcatccatgaatggtgttgcagatcttgtacgctccctcccctgcggttccgcggggaggacggatgctggtatggcatggagattagaccggtgaaggaaaaggaggaaaacctggtccggagcatggtgtccgccgggagcggagaggttgactctttttccctcggcatcctgtgtgtgagcattcttatcgaagaggtcatgagatcccgctggtctcggaaaatgctgatgacagggaccctcgcggtgttcctgctgcttattatgggacagctgacatggaatgatctcatcagactgtgcattatggttggcgctaacgccagcgaccgcatgggcatggggaccacctacctcgccctgatggctacatttaagatgagacctatgttcgccgtgggacttctgtttcggcgcctcacgtccagagaggtcctgctgcttaccatcggcctgtctctcgtggcgagcgtggaactgcccaattccctcgaggaactgggggatggacttgctatgggcatcatgatgctgaaactcctgacagacttccaaccccaccagctgtggaccacacttctgtctctcacctttattcggacgagcctgtccctcgattatgcctggaagacaatggccatggctctgagcatcgtctctcttttccctctgtgtctgtccaccaccagccagaaaacaacctggctcccggttctgcttgggtcttttggatgcaagcccctgacaatgttcctcattacggagaacaagatctggggccgcaaatcctggcctattaacgaaggcatcatggccgtggggatcgtgagcattctgctctcttccctgcttaagaatgacgtccccctggctggacctctgatcgccggcgggatgctcattgcgtgttacgtgatcagcggatccagcgccgatctgtctcttgagaaagctgccgaggttagctgggaagaggaagctgagcattccggcacctctcacaacattctggtggaagtccaggacgatgggacaatgaagatcaaagacgaggagagagatgacaccctcacaatcctgctcaaggccaccctgcttgccgtgagcggagtttatcccatgtccattcctgctacgctgtttgtgtggtacttctggcaaaaaaagaagcagcggtctggcgtcctgtgggatacccccagcccgcctgaagtggagcgcgcggtcctcgacgacggcatctatagaattctgcagcgggggcttctgggacgctcccaggtgggcgttggggtgttccaagatggagtctttcatacaatgtggcacgtgaccagaggcgccgttctcatgtaccaggggaaacggctggaaccctcttgggctagcgtgaagaaagacctcatctcctacggaggcggctggagattccaggggagctggaatacaggagaggaggtccaggtgattgccgtggaacctggcaagaaccccaaaaatgttcaaaccacaccggggacgtttaagacccctgagggagaagtcggcgccatcgctctggatttcaagcccgggacatctggatcccctattgtgaaccgcgagggcaaaatcgtgggcctttatgggaatggagtcgtgaccaccagcggcacatacgtttctgccatcgcgcaggctaaggcctcccaggaagggcccctgcccgagattgaggacgaagtgtttaaaaagcggaacctgacgatcatggatctccaccctggaagcggcaaaaccagacgctatctgccggccattgtccgggaggctatcaagagaaagcttcgcacactgattctcgcccccacccgggtggttgcgtccgaaatggctgaggccctgaaagggatgcctatcagataccaaacaaccgccgtgaagtctgaacatacgggccgcgagatcgtcgacctgatgtgccacgctacattcaccatgcggctccttagccccgtgagagttcctaattataacatgattatcatggatgaggcccattttaccgaccccgcttccattgccgcgcggggatacatcagcacacgcgtgggcatgggggaagccgctgccattttcatgaccgctacacctccgggatctgccgaggcctttccccagtccaatgctgtcatccaggatgaagagagagacatccctgaacggagctggaactctggctatgattggattaccgacttccccgggaaaacggtgtggtttgtgcctagcatcaagtccggaaatgacattgcgaactgtctgcgcaaaaatggcaagagagtcatccagctgtctcggaagacattcgataccgagtaccaaaaaacaaagaacaacgactgggattacgttgtgaccacggacattagcgagatgggggccaatttcagagctgatcgcgtgatcgacccccggagatgcctcaaaccggtcattctgaaggatggccctgaacgcgtgatccttgccggacccatgcccgttaccgtggcctccgctgcccagcggagaggccgcatcgggcggaaccagaataaagagggagaccagtatatttacatgggccaacctctgaacaatgatgaagaccacgcgcattggacagaggctaagatgctcctggataacatcaatacccccgaggggattatccctgccctgtttgaaccggagagagaaaagtctgccgctattgacggagagtatcgcctcagaggcgaagcccggaaaacattcgtcgagcttatgcgcagaggggatctgcccgtgtggctgagctacaaggttgcgtccgagggctttcagtatagcgaccggcgctggtgcttcgacggagaaagaaacaatcaggtgctcgaggaaaacatggatgtcgagatctggaccaaagaaggcgagcggaagaaactgagacctcgctggcttgacgcccggacatactctgatcccctggctctcagagagtttaaggaattcgccgctgggcgccggtccgtgagcggagacctgatcctggagattggcaaactccctcagcaccttaccctgagagcccaaaatgctctggataacctcgtcatgctgcacaattccgaacaggggggaaaggcctatcggcatgcgatggaggaacttcccgacacgatcgagacactgatgctcctggccctgattgctgtgctcaccggcggcgttaccctttttttcctgtctgggaagggactgggcaaaacaagcatcgggctcctgtgtgtgatggcctcctctgctcttctgtggatggccagcgtggagccgcactggattgccgcttccatcatcctcgaatttttcctgatggtcctgctcattcctgagcccgatcgccagagaacccctcaggacaaccaacttgcgtacgttgtgatcggactgctgtttatgattctcacagtggccgctaatgaaatgggcctgcttgagacgaccaagaaagatctggggatcggacatgtcgccgccgagaaccaccaccatgctacaatgctcgacgtggatctgcggcccgccagcgcgtggaccctgtacgccgttgctacaaccgtgattacgcctatgatgcgccacaccatcgaaaacacaaccgccaatatttctctcacagctatcgccaaccaggcggccatccttatgggcctggacaagggctggcccatttccaaaatggatatcggggtcccgctgctcgctctgggatgctatagccaggtgaatcctcttaccctgacggccgctgtcctcatgctggtggcccattacgctattatcggccccgggctgcaagccaaggcgacaagagaggcccagaagcggaccgctgccggaattatgaaaaaccccacagttgacggcatcgtgaccatcgacctcgatcctgtcgtgtatgacgctaagttcgaaaaacagcttgggcagattatgctgctgatcctctgtacctctcaaattctgcttatgcgcacaacgtgggccctgtgcgagtccatcaccctcgccacaggaccgctgaccacactgtgggaaggcagccccggcaagttttggaataccacgattgcggtttctatggctaacatcttcagagggagctacctcgccggagctggccttgccttctccctgatgaaatctctggggggaggccggcgcgggacaggagcccagggcgagaccctcggcgagaagtggaagagacagctgaatcagcttagcaaatccgaatttaacacctataagaaaagcgggatcatggaggtggatcggtccgaagctaaggagggactgaaaagaggcgaaacaaccaagcacgccgtctctcgcgggacagcgaagctccggtggttcgtggagagaaatctggtgaaacctgagggaaaggttattgacctgggctgtgggcgcggaggctggagctactattgcgccggcctcaaaaaggtcacggaagtgaaagggtacaccaagggaggccccgggcatgaggaacctatccccatggctacatacggatggaaccttgtgaaactgcactccggcaaggatgtctttttcacccctccggagaagtgtgacacactgctctgcgatattggggaatctagccccaatcctaccatcgaggagggacggacgctgagagttcttaaaatggtggaaccctggctgcgcggcaaccaattttgtattaagatcctcaatccttatatgccctccgtggtcgagaccctggaacagatgcagcggaaacacggcgggatgctggtgagaaacccgctctctcgcaatagcacacatgagatgtactgggtttcctgcggaaccggcaacattgtgagcgccgtcaatatgacatctcggatgctgcttaacagattcaccatggctcaccgcaagcctacatatgagcgggacgtggatctgggggccggaaccagacatgttgcggtggaacccgaggtcgccaacctcgacatcatcggccagcgcattgaaaatatcaaaaacgagcacaagtccacgtggcactacgatgaagacaatccctataagacatgggcttaccatgggagctatgaggtgaaaccttctggatccgccagctctatggtgaacggcgtcgttagactgcttaccaagccctgggacgtgattcctatggtgacccaaatcgctatgacagatacgaccccgtttggccagcagcgggtcttcaaagagaaggtggacacacgcacccccagagccaaacgggggacagctcaaattatggaagttaccgccaagtggctgtggggatttctctccagaaataagaaacctcggatctgtacacgcgaggaattcaccagaaaggtgcggagcaacgcggccatcggcgctgtctttgtggatgagaatcagtggaactccgccaaagaagctgttgaggacgagcgcttctgggatctggtgcacagagaacgggagctgcataagcaggggaaatgcgccacgtgcgtctacaatatgatgggaaagcgcgaaaagaaactcggcgagtttgggaaggccaaaggcagcagagcgatttggtacatgtggctgggagctcggttccttgaattcgaggccctgggctttatgaacgaggaccactggttctctcgcgaaaatagcctctccggggtggagggagaaggcctgcataagcttgggtatatcctgagagatatttctaaaatccccggaggcaacatgtacgccgacgataccgctgggtgggacacacggattaccgaggatgacctccagaatgaggccaagatcacagatatcatggaacctgagcacgctctgctggccaccagcatttttaaactcacgtatcaaaacaaggttgtgcgcgtccagagacccgcgaagtccggcacagtgatggacgtcatctctcggcgcgaccagagaggaagcggccaggtggggacctacggactgaatacattcaccaacatggaagttcaacttattcggcagatggagtccgaaggcatcttttctccgagcgagctggagacgcctaacctcgccaaaagagtgctggattggcttgaaaagcacggggctgagcgcctgaaacggatggccatttccggagacgattgtgtcgtgaagcccatcgacgatagattcgctaccgccctcacagcgctgaatgacatgggcaaagtgcgcaaggatatccctcagtgggaacccagcaaggggtggaacgactggcagcaagttcctttttgctctcatcacttccatcagctgattatgaaagatggccgggagatcgtggtcccctgtagaaatcaggacgaactcgtgggacgcgcccgggtttcccagggcgctgggtggagcctgagagagaccgcctgccttggaaagtcttatgctcaaatgtggcagctgatgtactttcaccgccgggatctcagactggccgctaacgccatttgttccgcggtgccggtcgactgggtgcctacaagccgcaccacatggtccatccacgcccatcaccagtggatgaccacggaggacatgctttctgtctggaatcgggtgtggattgaagagaacccctggatggaagataaaacacatgttagctcctgggaggaagtgccctatctgggcaagagagaggaccaatggtgcgggagcctcatcggactgaccgctcgggccacctgggccacaaatattcaggtcgctatcaaccaggtgagacgcctgatcggcaatgagaactacctcgattacatgacctctatgaaacggttcaagaatgaatccgaccctgagggggccctgtggtga

SEQ ID NO: 18501 - RNA, 9879 nt, synthetic construct
  misc_feature 1..9879: note = derived and/or modified CDS sequence (opt5) from DENV-1__FJ850084__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggtggaacccgacgatgtcgactgttggtgcaatgcgaccgatacgtgggtgacctatggaacatgttcccaaaccggcgagcacagacgggacaagcgctctgttgctctggcccctcatgtggggctcggactggagacaagaaccgaaacgtggatgagctccgagggcgcctggaaacagattcagaaggtcgaaacatgggctcttcggcaccccggcttcaccgtgatcgccctgtttctcgctcatgccattgggacatctatcacccagaagggaatcattttcatcctgcttatgctggttacccctagcatggcgatgcgctgcgtgggcattgggaacagagattttgtcgagggactctccggcgccacatgggtggacgtggtcctggagcacgggagctgtgttacgaccatggctaaaaataagcccacactggatatcgaactcctgaaaaccgaggtgacaaaccctgccgtgcttcggaagctgtgcattgaagctaaaatctctaataccacgacagactcccgctgtccgacccaaggagaggccaccctcgtcgaagagcaggatgcgaacttcgtgtgcagacggacatttgttgaccgcggctggggcaatgggtgtggactgttcggcaaggggagccttctgacctgcgccaagtttaaatgcgtgacaaagctcgagggaaaaattgtccagtacgaaaacctgaagtattctgtgatcgttacggtgcacaccggcgatcagcatcaagtcgggaatgagacaaccgaacacggaacaatcgctaccattacgccccaggcccctacctccgagatccagctgacagactacggcgctctcaccctggactgtagccccagaacaggccttgatttcaacgaaatggtgctgctcaccatgaaagagaagtcttggctggtccataaacagtggtttcttgacctgcctctcccctggacgtccggggccagcacatcccaagagacctggaatcggcaggatctgctggtgacattcaagaccgcccacgctaagaaacaggaagttgtggtcctcggatctcaagagggcgcgatgcacaccgccctgacaggggctacggaaattcagaccagcggaacaaccacaatctttgccggccatcttaagtgccgcctgaaaatggacaagctcaccctgaaagggatgtcctatgtgatgtgtacgggcagcttcaagctggagaaggaagttgccgagacacagcacggaaccgtgcttgtccaggtgaaatacgagggcaccgatgctccgtgcaagattcctttcctcacacaagacgaaaaaggggtgacccagaacggaagactgatcacagccaatcccatcgttacggataaggagaaacctgtcaacattgaaaccgagcccccctttggcgagtcttatatcgtggtgggggcgggagaaaaggctctgaagctctcctggttcaaaaagggcagctctattgggaaaatgtttgaggccacagcccggggcgctagacgcatggccatcctgggagacaccgcttgggatttcggcagcattgggggactttttacatccgtcggcaagctgatccatcaggtgttcggggccgcgtacggagttctcttttctggcgtgagctggaccatgaaaatcgggattggcatcctgctgacgtggcttggactcaattcccggagcacctctctgtccatgacatgtattgccgtcggcatggtgaccctgtacctcggggttatggtgcaggctgacagcggatgcgtcatcaactggaagggcagagaactgaagtgtgggtctggaattttcgtgacaaacgaggttcacacctggacagaacaatataaatttcaggccgattcccctaagcgccttagcgctgccatcggcaaagcgtgggaggagggggtgtgcggcattcggtccgccaccagactggaaaatatcatgtggaagcagatctctaacgagctcaattacattctgctggaaaacgacatgaaattcacggtcgtggtgggagacgctaatggcatccttacacaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattcttatacacagatgtgcgaccaccgcctgatgagcgccgctattaaggattccaaagcggttcacgccgacatgggctactggatcgaaagcgagaagaatgaaacctggaagctcgctcgggcctctttcatcgaggtgaaaacatgtatttggcccaagtcccataccctgtggagcaacggggtgcttgaatctgagatgatcattccgaaaatctatggaggccctacatcccaacacaattacagacccgggtacttcacccagacggccggaccttggcatctgggcaagctcgagctggattttgacctgtgcgaagggaccacagtcgtggttgatgagcactgcggatatcgcggccccagccttcggaccacaaccgtgacgggcaaaattatccacgaatggtgttgcagatcttgtacactccctcccctgcggttccgcggggaggacggatgctggtacggcatggagatcagaccggtcaaggaaaaggaggaaaacctggtgcggagcatggtttccgctgggagcgccgaggtggactctttttccctcggaattctgtgtgtcagcatccttattgaagaggtgatgagatcccgctggtctcggaaaatgctgatgaccggcacactcgcggttttcctgctgcttatcatggggcagctgacctggaatgatctcattagactgtgcatcatggtgggagctaacgccagcgaccgcatgggcatgggcaccacatatctcgccctgatggctacgtttaagatgagacctatgttcgccgtcgggcttctgtttcggaaactcacctcccgcgaggtgctgctgcttacaattggactgtctctcgtggcgagcgtcgaactgcccaattccctcgaggaactgggcgatgggcttgctatgggaatcatgatgctgaagctcctgaccgacttccaaccccatcagctgtggacaacccttctgtctctcacgtttatcagaacaagcctgtccctcgattacgcctggaaaaccatggccatggctctgagcattgtttctcttttccctctgtgtctgtccaccacaagccagaagaccacatggctcccggtgctgcttggctcttttgggtgcaagcccctgacgatgttcctcatcaccgagaacaaaatttggggacggaagtcctggcctatcaacgaaggcattatggccgtgggcatcgtcagcatcctgctctcttccctgcttaaaaatgacgtgcccctggctgggcctctgattgccggaggcatgctcatcgcgtgttatgttattagcgggtccagcgccgatctgtctcttgagaaggctgccgaggtgagctgggaagaggaagctgagcactccggaacatctcataacatcctggtcgaagtgcaggacgatggcaccatgaaaattaaggacgaggagcgcgatgacacactcaccatcctgctcaaagccacgctgcttgccgttagcggggtgtaccccatgtccatccctgctaccctgtttgtctggtatttctggcaaaagaagaaacagagatctggagtgctgtgggatacacccagcccgcctgaagtcgagcgggcggtgctcgacgacggcatttaccgcatcctgcagagaggccttctggggcggtcccaggttggagtgggcgtcttccaagatggggtgtttcacaccatgtggcatgttacacgcggagccgtgctcatgtaccagggcaagagactggaaccctcttgggctagcgtcaaaaaggacctcatttcctatgggggaggctggcggttccagggcagctggaataccggggaggaggtgcaggtgatcgccgttgaacctggaaaaaaccccaagaatgtccaaacaacgccgggcacctttaagacacctgagggggaagtgggagccattgctctggatttcaaacccggcacctctgggtcccctatcgtgaacagagagggaaagattgtcggcctttacggcaatggggtggttaccacaagcggaacgtatgtgtctgccatcgcgcaggctaaagcctcccaggaaggccccctgcccgagatcgaggacgaagtctttaagaaacgcaacctgaccattatggatctccaccctgggagcggaaagacacggagatacctgccggccatcgtgcgcgaggctattaagcggaaacttagaaccctgatcctcgcccccacacgcgttgtggcgtccgaaatggctgaggccctgaagggcatgcctattcggtatcaaaccacggccgtcaaatctgaacacacagggagagagatcgtggacctgatgtgccatgctaccttcaccatgcgcctccttagccccgttcgggtgcctaattacaacatgatcattatggatgaggcccactttacagaccccgcttccatcgccgcgagaggctatattagcacccgggtcggaatgggcgaagccgctgccatcttcatgacagctacccctccggggtctgtggaggcctttccccagtccaatgccgtgattcaggatgaagagcgcgacatccctgaaagaagctggaactctggatacgattggatcacggacttccccggcaagacagtctggtttgttcctagcattaaatccgggaatgacatcgctaactgtctgcggaagaatggaaagcgcgtgattcagctgtctagaaaaaccttcgatacagagtaccaaaagaccaaaaacaacgactgggattatgtggtcacgaccgacatcagcgagatgggcgcgaatttccgggccgatagagtgattgacccccgccggtgcctcaagccggttatcctgaaagatgggcctgaaagagtgattcttgctggccccatgcccgtcacagtggcctccgccgctcagcgccggggaagaatcggccgcaaccagaataaggagggggaccagtacatctatatgggacaacctctgaacaatgatgaagaccatgcccactggaccgaggcgaagatgctcctggataacattaatacacccgagggcatcattcctgctctgtttgaaccggagcgggaaaaatctgccgccatcgacggggagtacagactccgcggagaagctagaaagaccttcgttgagcttatgcggcgcggcgatctgcccgtgtggctgagctataaagtcgcctccgaggggtttcagtacagcgacagacggtggtgcttcgacggcgaacgcaacaatcaggtgctcgaggaaaacatggatgtcgagatttggacaaaggaaggagagagaaaaaagctgcggcctagatggcttgacgcgcgcacctattctgatcccctggccctccgggagtttaaagaattcgctgccggcagacgctccgtgagcggggacctgatcctggagatcggaaagctccctcagcatcttacgctgcgggctcaaaatgccctggataacctcgttatgctgcacaattccgaacagggcgggaaggcttacagacacgccatggaggaacttcccgacacaattgagaccctgatgctcctggcgctgatcgccgtgctcaccggaggcgtgacactttttttcctgtctggcaaagggctgggaaagaccagcattggcctcctgtgtgtcatggcttcctctgcccttctgtggatggctagcgttgagccgcattggatcgccgcctccattatcctcgaatttttcctgatggtgctgctcatccctgagcccgatcggcagcgcacacctcaggacaaccaacttgcttacgtggtcattgggctgctgtttatgatcctcacggtggcggccaatgaaatgggactgcttgagaccacaaaaaaggatctgggcattgggcacgttgctgccgagaaccatcaccacgccaccatgctcgacgtggatctgagacccgctagcgcctggacactgtatgcggtcgccaccacggtgatcacccctatgatgcggcatacaattgaaaacaccacagctaatatctctctcaccgccattgctaaccaggccgcgatccttatgggactggacaaaggctggcccatctccaagatggatattggcgtcccgctgctcgccctggggtgctacagccaggtgaatcctcttacgctgacagctaccgttctcatgctggtggcccactatgctatcattggacccggcctgcaagccaaggctacacgcgaggcccagaaaagaaccgcggccgggatcatgaagaaccccaccgtcgacggaattgtgacaatcgacctcgatcctgttgtgtacgacgctaaattcgaaaagcagcttggccagatcatgctgctgattctctgtacgtctcaaatcctgcttatgcggaccacatgggccctgtgcgagtccattaccctcgctacagggccgctgaccacgctgtgggaaggaagccccggcaaattttggaatacaaccatcgccgtctctatggccaacattttccgcggcagctatctcgcgggggctggacttgccttctccctgatgaagtctctgggcgggggaagacggggcaccggggctcagggagagacactcggcgagaagtggaaacgccagctgaatcagcttagcaagtccgaatttaacacctacaaaaagagcggcatcatggaggtggatagatccgaagccaaagaggggctgaagcggggagaaacaacgaagcatgccgtgtctagaggcaccgctaaactccgctggttcgttgagcggaatctggtcaagcctgaggggaaagtgatcgacctgggatgtggcagagggggatggagctattactgcgccggcctcaagaaagtgacagaagtcaagggctacaccaaagggggacccggccacgaggaacctattcccatggcgacatatgggtggaaccttgttaagctgcattccggaaaggatgtgtttttcacccctccggagaaatgtgacacgctgctctgcgatatcggcgaatctagccccaatcctaccattgaggaggggcgcacactgcgggtgcttaagatggtcgaaccctggctgagaggaaaccaattttgtatcaaaattctcaatccttacatgccctccgtggttgagaccctggaacagatgcagcgcaagcacggcggcatgctggtgcggaacccgctctctagaaatagcacacacgagatgtattgggtctcctgcgggaccggaaacatcgtgagcgccgttaatatgacatctcgcatgctgcttaaccggttcaccatggctcatagaaaacctacgtacgagcgcgacgtggatctgggcgccgggacacggcacgtcgctgtggaacccgaggtggccaacctcgacattatcggacagagaatcgaaaatattaagaacgagcataagtccacctggcactatgatgaagacaatccctacaaaacctgggcgtatcacggcagctacgaggtcaagccttctgggtccgccagctctatggttaacggagtggtgcgcctgcttacaaaaccctgggacgtcatccctatggtgacgcaaattgctatgaccgatacaaccccgtttggccagcagagagttttcaaggagaaagtggacacacggaccccccgcgccaagagaggcacagctcaaatcatggaagtcaccgccaagtggctgtgggggtttctctcccggaataaaaagcctagaatttgtacgcgggaggaattcacccgcaaagtgagaagcaacgctgccatcggagcggtttttgtggatgagaatcagtggaactccgccaaggaagctgtcgaggacgagcggttctgggatctggtgcatcgcgaaagagagctgcacaaacagggcaagtgcgccacatgcgtttacaatatgatggggaagcgggaaaaaaagctcggagagtttggcaaagctaaggggagccgcgccatctggtatatgtggctgggcgccagattccttgaattcgaggcgctgggatttatgaacgaggaccattggttctctcgggaaaatagcctctccggcgtggagggggaaggactgcacaaacttggctacattctgcgcgatatctctaagattcccgggggaaacatgtatgctgacgataccgccggctgggacacaagaatcaccgaggatgacctccagaatgaggccaaaattacggatatcatggaacctgagcatgctctgctggccacaagcatctttaagctcacctaccaaaacaaggtcgtgcgggtccagcgccccgctaaatccgggacagtgatggacgttatttctagacgggaccagcgcggcagcggacaggtgggcacctatgggctgaatacgttcaccaacatggaagtccaacttatcagacagatggagtccgaaggaattttttctccgagcgagctggagacacctaacctcgccaagcgggtgctggattggcttgaaaaacacggcgcggagagactgaagcgcatggccatctccggggacgattgtgtggttaaacccattgacgatcggttcgctaccgccctcacagctctgaatgacatgggaaaggtgagaaaggatatccctcagtgggaacccagcaaaggctggaacgactggcagcaagtccctttttgctctcaccatttccaccagctgatcatgaaggatgggcgcgacattgtggttccctgtcggaatcaggatgagctcgtgggcagagcccgcgtctcccagggagcgggctggagcctgcgggaaaccgcctgccttgggaaatcttacgctcaaatgtggcagctgatgtattttcatagacgcgacctccggctggccgctaacgccatctgttccgctgtgccggtcgactgggtgcctacaagcagaaccacgtggtccattcacgcccaccatcagtggatgacaaccgaggatatgctttctgtttggaatcgcgtgtggatcgaggaaaacccctggatggaggacaagacccacgtcagctcctgggaagaggtgccctacctgggaaaacgggaagatcaatggtgcggcagcctcattgggctgacagcgagagccacctgggctacaaatatccaggttgccattaaccaggtgcggagactgatcggaaatgagaactacctcgactatatgacgtctatgaagcgcttcaagaatgagtccgatcctgaaggcgccctgtggtga

SEQ ID NO: 18502 - RNA, 9879 nt, synthetic construct
  misc_feature 1..9879: note = derived and/or modified CDS sequence (opt5) from DENV-1__FJ850087__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattctcacacacagatgtgcgaccaccgcctgatgagcgccgctattaaggattccaaagcggttcatgccgacatgggctattggatcgaaagcgagaagaatgaaacctggaagctcgctcgggcctctttcatcgaggtgaaaacatgtatttggcccaagtcccacaccctgtggagcaacggggtgcttgaatctgagatggtcatcccgaaaatttacggaggccctatctcccaacataattatagacccgggtacttcacacagaccgccggaccttggcacctgggcaagctcgagctggattttgacctgtgcgaagggacgaccgtggttgtggatgagcactgcggataccgcggccccagccttcggacaaccacagtcaccggcaaaattatccatgaatggtgttgcagatcttgtacgctccctcccctgcggttccgcggggaggacggatgctggtatggcatggagatcagaccggtgaaggaaaaggaggaaaacctggttcggagcatggtgtccgctgggagcggagaggtcgactctttttccctcggcattctgtgtgtgagcatccttattgaagaggttatgagatcccgctggtctcggaaaatgctgatgacagggaccctcgtggtcttcctgctgcttatcatgggacagctgacatggaatgatctcattagactgtgcatcatggtgggcgccaacgcgagcgaccgcatgggcatggggaccacctacctcgctctgatggccacatttaagatgagacctatgttcgccgtgggacttctgtttcggcgcctcacgtccagagaggtcctgctgcttaccgttggcctgtctctcgtggctagcgtggaactgcccaattccctcgaggaactgggggatggacttgccatgggcattatgatgctgaaactcctgacagacttccaaccccaccagctgtggaccacacttctgtctctcacctttatccggacgagcctgtccctcgattatgcgtggaagacaatggctatggccctgagcatcgtctctcttttccctctgtgtctgtccaccaccagccagaaaacaacctggctcccggtgctgcttgggtcttttggatgcaagcccctgacaatgttcctcattacggagaacaagatctggggccgcaaatcctggcctattaacgaaggcatcatggccgttgggattgtgagcatcctgctctcttccctgcttaagaatgacgtccccctggctggacctctgatcgccggcgggatgctcattgcttgttacgtgatcagcggatccagcgccgatctgtctcttgagaaagcggccgaggttagctgggaagaggaagctgagcattccggcacctctcacaacattctggtggaagtccaggacgatgggacaatgaagatcaaagacgaggagagagatgacaccctcacaattctgctcaaggccaccctgcttgctgtgagcggagtctatcccatgtccatccctgccacgctgtttgtgtggtacttctggcaaaaaaagaagcagcggtctggcgttctgtgggatacccccagcccgcctgaagtggagcgcgccgtcctcgacgacggcatctatagaattctgcagcgggggcttctgggacgctcccaggtgggcgttggggtgctccaagatggagtcttccatacaatgtggcacgtgaccagaggcgctgtgctgatgtaccaggggaaacggctcgaaccctcttgggcgagcgttaagaaagacctgatctcctacggaggcggctggagatttcaggggagctggaatacaggagaggaggtccaggtgattgccgtggaacctggcaagaaccccaaaaatgtccaaaccacaccggggacgttcaagacccctgagggagaagtgggcgctatcgcccttgattttaagcccgggacatctggatcccctattgttaaccgcgagggcaaaatcgtgggcctgtatgggaatggagtcgtgaccaccagcggcacatacgtttctgccattgctcaggccaaggcgacgcaggaagggcccctgcccgagatcgaggacgaagtgttcaaaaagcggaacctcaccatcatggatctgcaccctggatccggcaaaacaagacgctatcttccggctattgtccgggaggccatcaagagaaagctgcgcaccctcattctggcccccacacgggtggttgctagcgaaatggccgaggcgctgaaagggatgcctatcagataccaaaccacggctgtgaagtccgaacatacaggccgcgagattgtcgacctcatgtgccacgccacctttaccatgcggcttctgtctcccgtgagagtgcctaattataacatgatcatcatggatgaggcccatttcacagaccccgctagcattgccgctcggggatacatctccacccgcgtcggcatgggggaagccgcggccatttttatgacagctacccctccgggaagcgttgaggccttcccccagtctaatgctgtgatccaggatgaagagagagacattcctgaacggtcctggaacagcggctatgattggatcacggactttcccgggaaaacagtgtggttcgtcccttctatcaagagcggaaatgacattgccaactgtctgcgcaaaaatggcaagagagtgatccagctctcccggaagacctttgatacagagtaccaaaaaaccaagaacaacgactgggattacgttgtgacgaccgacatttctgagatgggggccaatttcagagctgatcgcgtcatcgacccccggagatgcctgaaaccggtgattcttaaggaaggccctgagcgcgttatcctggcgggacccatgcccgtgacagtcgccagcgctgcccagcggagaggccgcattgggcggaaccagaataaagaaggagatcagtatatctacatgggccaacctctcaacaatgacgaggatcacgcccattggaccgaggctaagatgctgctggacaacatcaatacacccgaagggattatccctgccctcttcgagccggaaagagagaagtccgcggctattgatggagaatatcgccttagaggcgaggcccggaaaacctttgtggagctgatgcgcagaggggacctgcccgtctggctctcttacaaggtggccagcgaaggcttccagtattccgatcggcgctggtgctttgacggagagagaaacaatcaggttctggaagagaacatggacgtggaaatctggacaaaagagggcgagcggaagaaacttagacctcgctggctggatgctcggacctacagcgaccccctcgccctgagagaattcaaggagtttgcggccgggcgccggtctgtgtccggagatctgattctcgaaatcggcaaacttcctcagcacctgacgctgagagctcaaaatgccctcgacaacctggtcatgcttcacaatagcgagcaggggggaaaggcttatcggcatgccatggaagagctgcccgatacaatcgagaccctcatgctgctggctctcattgccgttcttaccggcggcgtgacactgttctttctgtccgggaagggactcggcaaaacctctatcgggctgctttgtgtgatggcgagctccgccctgctctggatggcttctgtcgaaccgcactggattgccgctagcatcattctggagttctttctgatggtgctccttatccctgaacccgaccgccagagaacacctcaggataaccaactggcctacgttgtgatcggactgctcttcatgattctgacggtcgccgctaatgagatgggccttctggagaccacaaagaaagacctcgggatcggacatgtggcggtcgaaaaccaccaccatgccaccatgctggatgtggacctgcggcccgcttccgcctggacactctacgccgttgctaccacggtgattacccctatgatgcgccacacaatcgagaacaccacagccaatattagccttaccgcgatcgccaaccaggctgccattctgatgggcctggataagggctggcccatctctaaaatggacatcggggtcccgctcctggctcttggatgctattcccaggtgaatcctctgacgctcacagccgcggttctgatgctggtggcccattacgctattatcggccccgggctccaagccaaggctaccagagaagcccagaagcggacagctgccggaattatgaaaaaccccaccgtcgatggcatcgtgaccattgaccttgaccctgtggtttatgatgcgaagtttgagaaacagctggggcagatcatgctgctcatcctgtgtacaagccaaattcttctgatgcgcacgacctgggccctctgcgaatctatcacactggctaccggaccgctgacaaccctctgggagggctcccccggcaagttctggaatacgacaattgccgtcagcatggctaacatctttagagggtcttaccttgccggagccggcctggcgttcagcctgatgaaatccctcgggggaggccggcgcgggaccggagctcagggcgagaccctgggcgaaaagtggaagagacagcttaatcagctgtctaaaagcgagttcaacacatataagaaatccgggattatggaagtggaccggagcgaggccaaggaaggactcaaaagaggcgagaccacaaagcacgctgtgtcccgcgggacggccaagctgcggtggtttgtcgagagaaatctggttaaacctgaaggaaaggtgatcgatctcggctgtgggcgcggaggctggtcttactattgcgccggccttaaaaaggtgaccgaggtcaaagggtacacaaagggaggccccgggcatgaagagcctatccccatggctacctacggatggaacctggtgaaactgcacagcggcaaggacgttttctttacacctccggaaaagtgtgataccctcctgtgcgacattggggagtcctctcccaatcctacgatcgaggaaggacggacccttagagtgctgaaaatggtcgagccctggctccgcggcaaccaattctgtattaagatcctgaatccttatatgcccagcgtggttgaaacactggagcagatgcagcggaaacacggcgggatgctcgtgagaaacccgctgtcccgcaattctacccatgagatgtactgggtcagctgcggaacaggcaacattgtgtccgccgtgaatatgaccagccggatgcttctgaacagatttacaatggcgcaccgcaagcctacctatgaacgggatgtcgacctcggggccggaacgagacatgttgctgtggagcccgaagtggccaacctggatatcattggccagcgcatcgagaatatcaaaaacgaacacaagtctacatggcactacgacgaggataatccctataagacctgggcttaccatgggtcctatgaggtcaaacctagcggatctgcctccagcatggtgaacggcgttgtgagacttctgaccaagccctgggacgtcattcctatggtgacacaaatcgcgatgacggacaccacaccgttcggccagcagcgggtttttaaagaaaaggtggatacccgcacacccagagccaaacgggggaccgctcaaattatggaggtcacagccaagtggctctggggattcctgtctagaaataagaaacctcggatctgtacccgcgaagagtttacgagaaaggtgcggtccaacgctgccattggcgctgttttcgtggacgaaaatcagtggaacagcgccaaagaggcggtcgaggatgaacgcttttgggacctggtgcacagagagcgggaactccataagcaggggaaatgcgccacctgcgtctacaatatgatgggaaagcgcgagaagaaactgggcgaattcgggaaggctaaaggctccagagccatctggtacatgtggcttggagctcggtttctggagttcgaggccctcggcttcatgaacgaagatcactggtttagccgcgagaattctctgagcggggtggaaggagagggccttcataagctggggtatatcctcagagacatttccaaaatccccggaggcaacatgtacgccgatgacacagcggggtgggatacccggattacagaggacgatctgcagaatgaagctaagatcaccgacattatggagcctgaacacgccctgctcgccacgtctatcttcaaactgacatatcaaaacaaggttgtgcgcgtccagagacccgctaagagcggcaccgtgatggatgtgatctcccggcgcgaccagagaggatctggccaggttgggacatacggacttaatacctttacgaacatggaggtgcaactgattcggcagatggaaagcgagggcatcttctccccgtctgagctcgaaacccctaacctggccaaaaaggtccttgactggctggagaaacacggggctgaaagactcaagcgcatggccattagcggagatgactgtgtggttaaacccatcgatgaccggtttgcgacagccctgaccgctctgaatgatatgggcaaggtgagaaaggacattcctcagtgggagccctccaaagggtggaacgattggcagcaagtccctttctgcagccatcactttcatcagctcatcatgaaggacggccgcgaaatcgtggtcccctgtcggaatcaggatgagctggtgggaagagcccgcgtttctcagggcgctgggtggtcccttcgggagacagcctgcctgggaaaaagctatgcgcaaatgtggcagctcatgtacttccacagacgcgacctgcggcttgccgctaacgccatttgttctgctgtgccggtcgattgggtgcctacctccagaacaacctggagcatccacgcccatcaccagtggatgacgacagaagacatgctgtccgtttggaatcgcgtgtggattgaggaaaacccctggatggaggacaagacccatgtctctagctgggaagaggtgccctatctcggcaaacgggaggatcaatggtgcgggtccctgatcggactgaccgctagagccacatgggcgaccaatattcaggtggccatcaaccaggttcggagactcattggcaatgaaaactacctggactacatgacaagcatgaagcgctttaagaatgagtctgatcctgaaggggctctttggtga

SEQ ID NO: 18503 - RNA, 9879 nt, synthetic construct
  misc_feature 1..9879: note = derived and/or modified CDS sequence (opt5) from DENV-1__FJ850090__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggtggaacccgacgatgtcgactgttggtgcaatgcgaccgatacgtgggtgacctatggaacatgttcccaaaccggcgagcacagacgggacaagcgctctgttgctctggcccctcatgtggggctcggactggagacaagaaccgaaacgtggatgagctccgagggcgcctggaaacagattcagaaggtcgaaacatgggctcttcggcaccccggcttcaccgtgatcgccctgtttctcgctcatgccattgggacatctatcacccagaagggaatcattttcatcctgcttatgctggttacccctagcatggcgatgcgctgcgtgggcattgggaacagagattttgtcgagggactctccggcgccacatgggtggacgtggtcctggagcacgggagctgtgttacgaccatggctaaaaataagcccacactggatatcgaactcctgaaaaccgaggtgacaaaccctgccgtgcttcggaagctgtgcattgaagctaaaatctctaataccacgacagactcccgctgtccgacccaaggagaggccaccctcgtcgaagagcaggatgcgaacttcgtgtgcagacggacatttgttgaccgcggctggggcaatgggtgtggactgttcggcaaggggagccttctgacctgcgccaagtttaaatgcgtgacaaagctcgagggaaaaattgtccagtacgaaaacctgaagtattctgtgatcgttacggtgcacaccggcgatcagcatcaagtcgggaatgagacaaccgaacacggaacaatcgctaccattacgccccaggcccctacctccgagatccagctgacagactacggcgctctcaccctggactgtagccccagaacaggccttgatttcaacgaaatggtgctgctcaccatgaaagagaagtcttggctggtccataaacagtggtttcttgacctgcctctcccctggacgtccggggccagcacatcccaagagacctggaatcggcaggatctgctggtgacattcaagaccgcccacgctaagaaacaggaagttgtggtcctcggatctcaagagggcgcgatgcacaccgccctgacaggggctacggaaattcagaccagcggaacaaccacaatctttgccggccatcttaagtgccgcctgaaaatggacaagctcaccctgaaagggatgtcctatgtgatgtgtacgggcagcttcaagctggagaaggaagttgccgagacacagcacggaaccgtgcttgtccaggtgaaatacgagggcaccgatgctccgtgcaagattcctttcctcacacaagacgaaaaaggggtgatccagaacggaagactgatcaccgccaatcccattgttacagataaggagaaacctgtcaacatcgaaacggagcccccctttggcgagtcttatattgtggtgggggcgggagaaaaggctctgaagctctcctggttcaaaaagggcagctctatcgggaaaatgtttgaggccaccgcccggggcgctagacgcatggccattctgggagacacagcttgggatttcggcagcatcgggggactttttacctccgtcggcaagctgatccatcaggtgttcgggacagcctacggagttctcttttctggcgtgagctggaccatgaaaattgggatcggcattctgctgacgtggcttggactcaattcccggagcacctctctgtccatgacatgtatcgcggtcggcatggtgaccctgtacctcggggttatggtgcaggccgacagcggatgcgtcattaactggaagggcagagaactgaagtgtgggtctggaatcttcgtgacaaacgaggttcacacctggacagaacaatataaatttcaggctgattcccctaagcgccttagcgccgctattggcaaagcctgggaggagggggtgtgcggcatccggtccgcgaccagactggaaaatatcatgtggaagcagatttctaacgagctcaattacatcctgctggaaaacgacatgaaattcacggtcgtggtgggagacgccaatggcattcttacacaggggaagaaaatgatccgcccgcaacccatggagcataagtatagctggaagtcctggggaaaagctaagattatcggcgccgatatccagaacaccacctttattatcgacgggcctgatacacccgaatgtcctgacgatcagcgggcttggaatatttgggaggtcgaggactacggattcggcatctttaccacgaacatttggctcaaactgagagattctcacacacagatgtgcgaccaccgcctgatgagcgccgccatcaaggattccaaagctgttcatgcggacatgggctattggatcgaaagcgagaagaatgaaacctggaagctcgcccgggcttctttcattgaggtgaaaacatgtatctggcccaagtcccacaccctgtggagcaacggggtgcttgaatctgagatgattatcccgaaaatttacggaggccctacatcccaacataattatagacccgggtacttcacccagacggccggaccttggcacctgggcaagctcgagctggattttgacctgtgcgaagggaccacagtcgtggttgatgagcactgcggataccgcggccccagccttcggaccacaaccgtgacgggcaaaatcatccatgaatggtgttgcagatcttgtacactccctcccctgcggttccgcggggaggacggatgctggtatggcatggagattagaccggtcaaggaaaaggaggaaaacctggtgcggagcatggtttccgccgggagcggagaggtggactctttttccctcggcatcctgtgtgtcagcattcttatcgaagaggtgatgagatcccgctggtctcggaaaatgctgatgaccgggacactcgctgttttcctgctgcttattatgggacagctgacctggaatgatctcatcagactgtgcattatggtgggcgccaacgcgagcgaccgcatgggcatggggaccacatacctcgctctgatggccacgtttaagatgagacctatgttcgccgtcggacttctgtttcggaaactcacctcccgcgaggtgctgctgcttacaatcggcctgtctctcgtggctagcgtcgaactgcccaattccctcgaggaactgggggatggacttgccatgggcatcatgatgctgaagctcctgaccgacttccaaccccaccagctgtggacaacccttctgtctctcacgtttattagaacaagcctgtccctcgattatgcgtggaaaaccatggctatggccctgagcatcgtttctcttttccctctgtgtctgtccaccacaagccagaagaccacatggctcccggtgctgcttgggtcttttggatgcaagcccctgacgatgttcctcattaccgagaacaaaatctggggccggaagtcctggcctattaacgaaggcatcatggccgtggggatcgtcagcattctgctctcttccctgcttaaaaatgacgtgcccctggctggacctctgatcgccggcgggatgctcattgcttgttacgttatcagcggatccagcgccgatctgtctcttgagaaggcggccgaggtgagctgggaagaggaagctgagcattccggcacatctcacaacattctggtcgaagtgcaggacgatgggaccatgaaaatcaaggacgaggagcgcgatgacacactcaccatcctgctcaaagccacgctgcttgctgttagcggagtgtatcccatgtccattcctgccaccctgtttgtctggtacttctggcaaaagaagaaacagagatctggcgtgctgtgggatacacccagcccgcctgaagtcgagcgggccgtgctcgacgacggcatctatcgcattctgcagagagggcttctgggacggtcccaggttggcgtgggggtcttccaagatggagtgtttcataccatgtggcacgttacacgcggcgctgtgctcatgtaccaggggaagagactggaaccctcttgggcgagcgtcaaaaaggacctcatctcctacggaggcggctggcggttccaggggagctggaataccggagaggaggtgcaggtgattgccgttgaacctggcaaaaaccccaagaatgtccaaacaacgccggggacctttaagacacctgagggagaagtgggcgctatcgccctggatttcaaacccgggacctctggatcccctattgtgaacagagagggcaagatcgtcggcctttatgggaatggagtggttaccacaagcggcacgtacgtgtctgccatcgctcaggccaaagcgtcccaggaagggcccctgcccgagattgaggacgaagtctttaagaaacgcaacctgaccatcatggatctccaccctggaagcggcaagacacggagatatctgccggctattgtgcgcgaggccatcaagcggaaacttagaaccctgattctcgcccccacacgcgttgtggcttccgaaatggccgaggcgctgaaggggatgcctatccggtaccaaaccacggctgtcaaatctgaacatacaggcagagagatcgtggacctgatgtgccacgccaccttcaccatgcgcctccttagccccgttcgggtgcctaattataacatgattatcatggatgaggcccattttacagaccccgcttccattgccgctagaggatacatcagcacccgggtcggcatgggggaagccgcggccattttcatgacagctacccctccgggatctgtggaggcctttccccagtccaatgctgtgatccaggatgaagagcgcgacatccctgaaagaagctggaactctggctatgattggattacggacttccccgggaagacagtctggtttgttcctagcatcaaatccggaaatgacattgccaactgtctgcggaagaatggcaagcgcgtgatccagctgtctagaaaaaccttcgatacagagtaccaaaagaccaaaaacaacgactgggattacgtggtcacgaccgacattagcgagatgggggccaatttccgggctgatagagtgatcgacccccgccggtgcctcaagccggttattctgaaagatggccctgaaagagtgatccttgcgggacccatgcccgtcacagtggcctccgctgcccagcgccggggcagaatcgggcgcaaccagaataaggagggagaccagtatatttacatgggccaacctctgaacaatgatgaagaccacgcccattggaccgaggctaagatgctcctggataacatcaatacacccgaggggattatccctgccctgtttgaaccggagcgggaaaaatctgcggctattgacggagagtatagactccgcggcgaagccagaaagaccttcgttgagcttatgcggcgcggggatctgcccgtgtggctgagctacaaagtcgcctccgagggctttcagtatagcgacagacggtggtgcttcgacggagaacgcaacaatcaggtgctcgaggaaaacatggatgtcgagatctggacaaaggaaggcgagagaaaaaagctgcggcctagatggcttgacgctcgcacctactctgatcccctggccctccgggagtttaaagaattcgcggccgggagacgctccgtgagcggagacctgatcctggagattggcaagctccctcagcaccttacgctgcgggctcaaaatgccctggataacctcgttatgctgcacaattccgaacaggggggaaaggcttatagacatgccatggaggaacttcccgacacaatcgagaccctgatgctcctggctctgattgccgtgctcaccggcggcgtgacactttttttcctgtctgggaaaggactgggcaagaccagcatcgggctcctgtgtgtcatggcgtcctctgcccttctgtggatggctagcgttgagccgcactggattgccgcttccatcatcctcgaatttttcctgatggtgctgctcattcctgagcccgatcggcagcgcacacctcaggacaaccaacttgcctacgtggtcatcggactgctgtttatgattctcacggtggccgctaatgaaatgggcctgcttgagaccacaaaaaaggatctggggatcggacatgttgcggccgagaaccaccaccatgctaccatgctcgacgtggatctgagacccgccagcgcctggacactgtacgctgtcgccaccacggtgattacccctatgatgcggcacacaatcgaaaacaccacagcgaatatttctctcaccgccatcgctaaccaggccgctatccttatgggcctggacaaaggctggcccatttccaagatggatatcggggtcccgctgctcgccctgggatgctatagccaggtgaatcctcttacgctgacagcgaccgttctcatgctggtggcccattacgctattatcggccccgggctgcaagccaaggctacacgcgaggcccagaaaagaaccgctgccggaattatgaagaaccccaccgtcgacggcatcgtgacaatcgacctcgatcctgttgtgtatgacgcgaaattcgaaaagcagcttgggcagattatgctgctgatcctctgtacgtctcaaattctgcttatgcggaccacatgggccctgtgcgagtccatcaccctcgctacaggaccgctgaccacgctgtgggaaggcagccccggcaaattttggaatacaaccattgccgtctctatggctaacatcttccgcgggagctacctcgccggagccggccttgcgttctccctgatgaagtctctggggggaggcagacgggggaccggagctcagggcgagacactcggcgagaagtggaaacgccagctgaatcagcttagcaagtccgaatttaacacctataaaaagagcgggatcatggaggtggatagatccgaagccaaagagggactgaagcggggcgaaacaacgaagcacgctgtgtctagagggaccgccaaactccgctggttcgttgagcggaatctggtcaagcctgagggaaaagtgattgacctgggctgtgggagaggaggctggagctactattgcgccggcctcaagaaagtgacagaagtcaaggggtacaccaaaggaggccccgggcatgaggaacctatccccatggctacatacggatggaaccttgttaagctgcactccggcaaggatgtgtttttcacccctccggagaaatgtgacacgctgctctgcgatattggggaatctagccccaatcctaccatcgaggagggacgcacactgcgggtgcttaagatggtcgaaccctggctgagaggcaaccaattttgtattaaaatcctcaatccttatatgccctccgtggttgagaccctggaacagatgcagcgcaagcacggcgggatgctggtgcggaacccgctctctagaaatagcacacatgagatgtactgggtctcctgcggaaccggcaacattgtgagcgccgttaatatgacatctcgcatgctgcttaaccggttcaccatggcgcacagaaaacctacgtatgagcgcgacgtggatctgggggccggaacacggcatgtcgctgtggaacccgaggtggccaacctcgacatcatcggccagagaattgaaaatatcaagaacgagcacaagtccacctggcactacgatgaagacaatccctataaaacctgggcttaccatgggagctatgaggtcaagccttctggatccgccagctctatggttaacggcgtggtgcgcctgcttacaaaaccctgggacgtcattcctatggtgacgcaaatcgcgatgaccgatacaaccccgtttggccagcagagagttttcaaggagaaagtggacacacggaccccccgcgccaagagagggacagctcaaattatggaagtcaccgccaagtggctgtgggattttctctcccggaataaaaagcctagaatctgtacgcgggaggaattcacccgcaaagtgagaagcaacgctgccatcggagctgtttttgtggacgagaatcagtggaactccgccaaggaagcggtcgaggatgagcggttctgggacctggtgcaccgcgaaagagagctgcataaacagggcaagtgcgccacatgcgtttacaatatgatggggaagcgggaaaaaaagctcggagagtttggcaaagctaaggggagccgcgccatttggtacatgtggctgggcgctagattccttgaattcgaggccctgggatttatgaacgaggatcactggttctctcgggaaaatagcctctccggcgtggagggggaaggactgcataaacttggctatatcctgcgcgacatttctaagatccccgggggaaacatgtacgccgatgacaccgcgggctgggatacaagaattaccgaggacgatctccagaatgaggctaaaatcacggacatcatggaacctgagcacgccctgctggccacaagcatttttaagctcacctatcaaaacaaggtcgtgcgggtccagcgccccgctaaatccgggacagtgatggacgttatctctagacgggatcagcgcggcagcggacaggtgggcacctacgggctgaatacgttcaccaacatggaagtccaacttattagacagatggagtccgaaggaatcttttctccgagcgagctggagacacctaacctcgccaagcgggtgctggactggcttgaaaaacacggcgctgagagactgaagcgcatggccatttccggggatgactgtgtggttaaacccatcgatgaccggttcgcgaccgccctcacagctctgaatgatatgggaaaggtgagaaaggacatccctcagtgggaacccagcaaaggctggaacgattggcagcaagtccctttttgctctcatcacttccatcagctgattatgaaggacgggcgcgatatcgtggttccctgtcggaatcaggacgagctcgtgggcagagcccgcgtctcccagggagctggctggagcctgcgggaaaccgcctgccttgggaaatcttatgcgcaaatgtggcagctgatgtactttcacagacgcgacctccggctggccgctaacgccatttgttccgctgtgccggtcgattgggtgcctacaagcagaaccacgtggtccatccacgcccatcaccagtggatgacaaccgaggacatgctttctgtttggaatcgcgtgtggattgaggaaaacccctggatggaggataagacccatgtcagctcctgggaagaggtgccctatctgggaaaacgggaagaccaatggtgcggcagcctcatcgggctgacagctagagccacctgggcgacaaatattcaggttgccatcaaccaggtgcggagactgatcggaaatgagaactacctcgattacatgacgtctatgaagcgcttcaagaatgagtccgaccctgaaggcgctctgtggtga

SEQ ID NO: 18504 - RNA, 9879 nt, synthetic construct
  misc_feature 1..9879: note = derived and/or modified CDS sequence (opt5) from DENV-1__FJ850093__SS-prME
  source 1..9879: mol_type = other RNA
agcgtgaccatgctgctcatgctgcttcccaccgccctggctttccacctcacgaccagaggcggggaacctcatatgatcgtctccaagcaggaacggggaaagtctctgctttttaagacaagcgccggcgttaatatgtgcaccctgattgccatggacctcggggaactgtgtgaagatacaatgacctacaagtgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaaacttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacacacctggctctcatggccacgtttaaaatgcggcctatgttcgcggtcggcctgctctttcgcagactgacctctcgggaggtgcttctgctcacaatcgggctgagcctgatggcttccatggaacttcccaactctctggaggaactcggagacggcctggccatggggattatgatgctcaagctgcttaccgagttccaaccccatcagctgtggacaaccctcctgagcctgacgtttgtgaaaacaaccctttccctggattatgcctggaagaccacagctatgatcctcagcatcgtctctctgttccctctctgtctgtccaccacaagccagaaaacgacctggcttccggttctgctgggatcttttggctgcaagcccctcacaatgttcctgattaccgaaaacaagatctggggccgcaaatcctggcctcttaatgaggggattatggccatcggaattgtgagcatcctgctctcttccctgctcaagaacgacgtgcccctggctggccctcttatcgccgggggaatgctgattgcgtgttacgtcatcagcggctccagcgccgatctgtctctcgagaaagctgccgaagtgagctgggagcaggaagctgagcactccggggcctctcataatattctggttgaagtgcaagacgatggaacaatgaagatcaaagacgaggagagagatgacacccttacgattctgctcaaggccaccctgctcgctgtcagcggcgtgtatcccatgtccatccctgcgacactgtttgtttggtacttctggcagaaaaagaagcagcggtctggcgtgctttgggatacccccagcccgcctgaagtcgagcgcgccgtgctggacgatgggatctatcgcattctgcagcggggactcctgggccgctcccaagtcggggtgggagttttccaggacggcgtgtttcacacaatgtggcacgtcaccagaggggctgtgcttatgtaccagggaaaacggctggaaccctcttgggccagcgttaagaaagacctcatctcctatggcggcgggtggagattccagggaagctggaacacaggcgaggaggtgcaagtcattgccgtggaacctgggaagaatcccaaaaacgtgcagacgaccccgggaacatttaagacccctgagggcgaagttggggctatcgccctggatttcaagcccggaacctctggctcccctattgtcaatcgcgagggcaaaatcgtggggctctacggaaacggcgtggtcacaacgagcgggacctacgtgtctgcgattgctcaggccaaggcctcccaagaaggacccctgcccgagatcgaggacgaagtttttaaaaagcggaatcttacaatcatggatctgcatcctggcagcgggaaaaccagacgctatctgccggctattgtgcgggaggccatcaagagaaagctccgcacactgattcttgcgcccacccgggtcgtggcttccgaaatggccgaggccctgaaaggcatgcctatcagataccagacgacagctgttaagtctgaaaccaccggacgcgagattgtggacctcatgtgccacgccacattcaccatgcggctgctgagccccgtcagagtgcctaactataatatgatcatcatggatgaggctcattttacagaccccgcctccattgcggcccggggctacatcagcacccgcgttgggatgggagaagctgccgctattttcatgacggccacacctccgggctctgtggaggcctttccccagtccaacgctgtcatccaggatgaagagagagacattcctgaacggagctggaactctgggtatgattggatcaccgacttccccggaaaaacagtgtggtttgtgcctagcatcaagtccggcaacgatattgcgaattgtctccgcaaaaacgggaagagagtcatccaactttctcggaagaccttcgacacggagtaccagaaaaccaagaacaatgactgggattatgttgtgacaaccgacattagcgagatgggcgccaacttcagagctgatcgcgtgatcgacccccggagatgcctgaaaccggtcattctgaaggatggacctgaacgcgtgatcctcgccggccccatgcccgttacagtggcctccgctgcccagcggagagggcgcattggacggaatcagaacaaagagggcgaccaatacgtctacatggggcagcctctgaataacgatgaagaccacgcgcattggaccgaggctaagatgcttctggataatatcaacacacccgagggaatcattcctgccctctttgaaccggagagagaaaagtctgccgctatcgacggcgagtatcgcctgagaggggaagcccggaaaaccttcgtggagctgatgcgcagaggcgatctccccgtttggcttagctacaaggtggcgtccgagggatttcagtatagcgaccggcgctggtgcttcgatggcgaaagaaataaccaggtcctggaggaaaatatggacgtggagatttggacgaaagaaggggagcggaagaaactgagacctcgctggctcgacgcccggacatactctgatcccctggctcttagagagtttaaggagttcgccgctggacgccggtccgtcagcggcgacctgatcctcgagattgggaaactgcctcaacacctgaccctcagagcccagaacgctcttgataatctggtgatgctgcacaactccgaacagggaggcaaggcctatcggcatgcgatggaggaactccccgacaccatcgagacactgatgcttctggccctcatcgctgttctgaccggcggggtgacactgtttttcctctctggaaagggccttgggaaaacgagcattggactgctgtgtgtgaccgcctcctctgctctcctgtggatggccagcgtcgagccgcactggatcgccgcttccattatccttgaatttttcctgatggttctcctgattcctgagcccgatcgccagagaacacctcaagacaatcagctggcgtacgtggtgatcggcctcctttttatgatcctgaccgtcgccgctaacgaaatggggctgctcgagacaaccaagaaagatctgggaattggctatgtggccgccgagaaccatcagcacgctacgatgcttgacgttgatctgcggcccgccagcgcgtggaccctctacgccgtggctacaaccgtcatcacacctatgatgcgccacaccattgaaaatacgacagccaacatctctctgaccgctattgccaatcaagcggccatcctgatgggcctcgacaaggggtggcccatttccaaaatggatatcggagtgccgcttctggctctgggctgctacagccaggtcaaccctctcacactgaccgccgctgtgcttatgctggttgcccattatgctatcattgggcccggactccaggccaaggcgaccagagaggcccagaagcggacagctgccggcatcatgaaaaatcccacggtggacgggattgtcgctatcgatctggaccctgtggtttacgacgccaagttcgaaaaacaactgggacagattatgctccttatcctgtgtacctctcagatcctgctcatgcgcacaacctgggccctgtgcgagtccattacacttgcgaccggcccgctgacgacactctgggaaggcagccccgggaagttttggaacaccaccatcgctgtgtctatggccaatattttcagaggaagctatctggctggcgccgggctggccttctccctcatgaaatctcttggaggcgggcggcgcggaacaggcgctcagggcgagaccctgggggagaagtggaagagacaactgaaccagctcagcaaatccgaatttaatacatacaagcggagcggaatcatggaggtcgatagatccgaagccaaagagggcctgaagcgcggggaaacgaccaaacacgcggtgtctcggggaacagccaaacttagatggttcgtggagcgcaacctggttaagcctgagggcaaagtcattgacctcgggtgtggacggggcggctggagctattactgcgctgggctgaagagagtgaccgaagtgaaaggatatacaaagggcgggcccggacatgaggaacctatccccatggccacctacggctggaatctggtcaaactccactccgggaaggatgtgtttttcatgcctccggagaaatgtgacacgcttctgtgcgatatcggagaatctagccccaaccctaccattgaggagggccgcacactgcgggttctcaagatggtggaaccctggctgaagggcaatcagttttgtatcaaaattcttaacccttacatgccctccgtcgtggagaccctggaacagatgcaaagaaagcatgggggaatgctcgttcgcaatccgctgtctcggaacagcacacacgagatgtattgggtgtcctgcggcaccgggaatatcgtcagcgctgtgaacatgacatctagaatgctgctcaaccgcttcaccatggcccaccggaaacctacgtacgagagagacgttgatctgggagcgggcacacgccatgtggccgtcgaacccgaggtggctaatcttgacattatcgggcagagaattgaaaacatcaagaatgagcacaaatccacctggcattatgatgaagacaacccctacaagacctgggcctatcacggaagctacgaggtgaagccttctggctccgctagctctatggtcaatggcgttgtgcggctgctcacaaaaccctgggatgtgatccctatggtcacgcagattgccatgaccgacacaaccccgtttgggcaacagcgcgtgttcaaggagaaagttgacacaagaacaccccgggctaagagaggaacaacccagatcatggaagtgacggccaaatggctgtggggctttctttcccggaacaagaagcctcgcatttgtaccagagaggagttcacacggaaagtccgcagcaatgcggccatcggggctgtgtttgttgatgagaaccagtggaactccgccaaggaagctgtggaggacgagagattctgggatctggtccaccgggaacgcgagctccataaacaaggaaagtgcgcgacctgcgtgtataacatgatgggcaaaagagaaaagaagctgggggagtttggcaaagccaagggaagccgggcgatttggtacatgtggctgggcgctcgcttcctcgagttcgaggccctggggtttatgaatgaggaccactggttctctagagaaaacagcctttccggagttgagggcgaagggctgcataaactcggatacatcctgcgggatatctctaagattcccggcgggaatatgtatgccgacgatacagctggctgggacacccgcatcacggaggatgaccttcagaacgaggccaaaattacagatatcatggaacctgagcacgctctgctcgccaccagcatttttaagctgacataccagaataaagtggtcagagtgcagcggcccgcgaagaacggaaccgtcatggacgtgatctcccgcagagatcaacggggctctgggcaggttggaacgtatggcctgaacaccttcacaaatatggaagtgcagctcatcagacagatggagagcgaagggatttttctgccgtccgagcttgagacccctaacctggccgaacgcgtcctcgactggctggagaagcatggagctgaacggcttaaaagaatggccatctctggcgacgattgtgtggtgaagcccattgacgatcgcttcgctacagccctgaccgcgctcaatgacatggggaaagttcggaaggatatccctcaatgggagcccagcaaaggctggaacgactggcaacaggtgcctttttgctcccaccacttccatcagctgattatgaaggatggaagagaaatcgtcgtgccctgtcgcaatcaagacgagctggttggccgggccagagtgagccagggggctggatggtctctccgcgagacagcctgcctgggcaagtcctacgctcagatgtggcaacttatgtattttcaccggagagatctgcgcctcgccgctaacgccatctgtagcgcggtcccggtggactgggtccctacctctcggacgacatggtccattcatgcccaccaccagtggatgaccaccgaagatatgctgagcgtgtggaatagagtttggatcgaggaaaacccctggatggaggacaaaacacatgtgtcctcttgggaagaggtcccctaccttgggaagcgggaggaccagtggtgcggaagcctgattggcctcaccgctagagccacatgggccacgaatatccaggtggctattaaccaagttcgccggctgatcgggaatgaaaactatctggattacatgacctccatgaaaagattcaagaatgagagcgaccctgaaggcgccctctggtga

SEQ ID NO: 18505 - RNA, 9879 nt, synthetic construct
  misc_feature 1..9879: note = derived and/or modified CDS sequence (opt5) from DENV-1__GU131863__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacatcaatggcattcttgctcaggggaagaaaatgatccgcccgcaacccatggagcataagtatagctggaagtcctggggaaaagccaagattatcggcgctgatatccagaacaccacctttattatcgacgggcctgatacacccgaatgtcctgacgatcagcgggcctggaatatttgggaggtggaggactacggattcggcatctttaccacgaacatttggctcaaactgagagattctcacacacagatgtgcgaccaccgcctgatgagcgccgctatcaaggattccaaagcggtccatgccgacatgggctattggatcgaaagcgagaagaatgaaacctggaagctcgctcgggcctctttcattgaggttaaaacatgtatctggcccaagtcccacaccctgtggagcaacggggtgcttgaatctgagatggtgattccgaaaatctacggaggccctatttcccaacataattatagacccgggtacttcacacagaccgccggaccttggcacctgggcaagctcgagctggattttgacctgtgcgaagggacgaccgtcgtggttgatgagcactgcggataccgcggccccagccttcggacaaccacagtgaccggcaaaatcatccatgaatggtgttgcagatcttgtacgctccctcccctgcggttccgcggggaggacggatgctggtatggcatggagattagaccggtcaaggaaaaggaggaaaacctggtgcggagcatggtttccgctgggagcggagaggtggactctttttccctcggcatcctgtgtgtcagcattcttatcgaagaggtgatgagatcccgctggtctcggaaaatgctgatgacagggaccctcgccgttttcctgctgcttattatgggacagctgacatggaatgatctcatcagactgtgcattatggtgggcgcgaacgctagcgaccgcatgggcatggggaccacctacctcgccctgatggccacatttaagatgagacctatgttcgctgtcggacttctgtttcggcgcctcacgtccagagaggtgctgctgcttaccgtgggcctgtctctcgtcgccagcgttgaactgcccaattccctcgaggaactgggggatggacttgcgatgggcatcatgatgctgaaactcctgacagacttccaaccccaccagctgtggaccacacttctgtctctcacctttatccggacgagcctgtccctcgattatgcttggaagacaatggccatggccctgagcattgtgtctcttttccctctgtgtctgtccaccaccagccagaaaacaacctggctcccggtgctgcttgggtcttttggatgcaagcccctgacaatgttcctcatcacggagaacaagatttggggccgcaaatcctggcctatcaacgaaggcattatggctgtcgggatcgtgagcatcctgctctcttccctgcttaagaatgacgttcccctggccggacctctgattgctggcgggatgctcatcgcctgttacgtgattagcggatccagcgcggatctgtctcttgagaaagccgctgaggtcagctgggaagaggaagccgagcattccggcacctctcacaacatcctggtggaagttcaggacgatgggacaatgaagattaaagacgaggagagagatgacaccctcacaatcctgctcaaggctaccctgcttgccgtgagcggagtctatcccatgtccatccctgccacgctgtttgtgtggtacttctggcaaaaaaagaagcagcggtctggcgtcctgtgggatacccccagcccgcctgaagtggagcgcgctgttctcgacgacggcatttatagaatcctgcagcgggggcttctgggacgctcccaggtgggcgtcggggtgttccaagatggagtttttcatacaatgtggcacgtgaccagaggcgcggtcctcatgtaccaggggaaacggctggaaccctcttgggccagcgtgaagaaagacctcatttcctacggaggcggctggagattccaggggagctggaatacaggagaggaggtgcaggttatcgctgtcgaacctggcaagaaccccaaaaatgtgcaaaccacaccggggacgtttaagacccctgagggagaagtgggcgccattgccctggatttcaagcccgggacatctggatcccctatcgtcaaccgcgagggcaaaattgtgggcctttatgggaatggagttgtgaccaccagcggcacatacgtctctgctatcgcccaggcgaaggctacgcaggaagggcccctgcccgagatcgaggacgaagtgtttaaaaagcggaacctgaccattatggatctccaccctggatccggcaaaacaagacgctatctgccggccatcgttcgggaggccattaagagaaagcttcgcaccctgatcctcgctcccacacgggtggtcgccagcgaaatggcggaggctctgaaagggatgcctattagataccaaaccacggccgtgaagtccgaacatacaggccgcgagatcgttgacctgatgtgccacgccaccttcaccatgcggctcctttctcccgtgagagtccctaattataacatgatcattatggatgaggctcattttacagaccccgccagcatcgctgcccggggatacatttccacccgcgtgggcatgggggaagcggccgctatcttcatgacagccacccctccgggaagcgtggaggcttttccccagtctaatgccgtcattcaggatgaagagagagacatccctgaacggtcctggaacagcggctatgattggatcacggacttccccgggaaaacagtttggtttgtgccttctattaagagcggaaatgacatcgccaactgtctgcgcaaaaatggcaagagagtgattcagctgtcccggaagaccttcgatacagagtaccaaaaaaccaagaacaacgactgggattacgtcgtgacgaccgacatctctgagatgggggctaatttcagagcggatcgcgttattgacccccggagatgcctcaaaccggtgatcctgaaggaaggccctgagcgcgtcattcttgccggacccatgcccgtgacagttgctagcgccgcccagcggagaggccgcatcgggcggaaccagaataaagaaggagatcagtatatctacatgggccaacctctgaacaatgacgaggatcacgctcattggaccgaggccaagatgctcctggacaacattaatacacccgaagggatcattcctgcgctgtttgagccggaaagagagaagtccgctgccatcgatggagaatatcgcctcagaggcgaggcccggaaaaccttcgtggagcttatgcgcagaggggacctgcccgtctggctgtcttacaaggtggctagcgaaggctttcagtattccgatcggcgctggtgcttcgacggagagagaaacaatcaggtcctcgaagagaacatggacgtggaaatttggacaaaagagggcgagcggaagaaactgagacctcgctggcttgatgcccggacctacagcgaccccctggcgctcagagaatttaaggagttcgccgctgggcgccggtctgtttccggagatctgatcctggaaatcggcaaactccctcagcaccttacgctgagagcccaaaatgctctggacaacctcgtgatgctgcacaatagcgagcaggggggaaaggcctatcggcatgctatggaagagcttcccgatacaattgagaccctgatgctcctggccctgatcgcggtgctcaccggcggcgtcacactttttttcctgtccgggaagggactgggcaaaacctctattgggctcctgtgtgttatggccagctccgctcttctgtggatggcctctgtggaaccgcactggatcgctgccagcattatcctcgagtttttcctgatggtgctgctcatccctgaacccgaccgccagagaacacctcaggataaccaacttgcctacgtcgtgattggactgctgtttatgatcctcacggttgctgcgaatgagatgggcctgcttgagaccacaaagaaagacctggggattggacatgtggccgtcgaaaaccaccaccatgctaccatgctcgatgtggacctgcggcccgcctccgcctggacactgtacgctgtcgccaccacggtgatcacccctatgatgcgccacacaattgagaacaccacagcgaatatcagcctcaccgccattgctaaccaggccgctatccttatgggcctggataagggctggcccatctctaaaatggacattggggttccgctgctcgccctgggatgctattcccaggtgaatcctcttacgctgacagcggccgtcctcatgctggtggctcattacgccatcattggccccgggctgcaagctaaggccaccagagaagctcagaagcggacagccgcgggaatcatgaaaaaccccaccgttgatggcattgtgaccatcgacctcgaccctgtcgtgtatgatgccaagttcgagaaacagcttgggcagatcatgctgctgattctctgtacaagccaaatcctgcttatgcgcacgacctgggctctgtgcgaatctattacactcgccaccggaccgctgacaaccctgtgggagggctcccccggcaagttttggaatacgacaatcgctgtgagcatggccaacattttcagagggtcttacctcgccggagcgggccttgctttcagcctgatgaaatccctggggggaggccggcgcgggaccggagcccagggcgagaccctcggcgaaaagtggaagagacagctgaatcagctttctaaaagcgagtttaacacatataagaaatccgggatcatggaagttgaccggagcgaggctaaggaaggactgaaaagaggcgagaccacaaagcacgccgtctcccgcgggacggccaagctccggtggttcgtggagagaaatctggtgaaacctgaaggaaaggtcatcgatctgggctgtgggcgcggaggctggtcttactattgcgctggcctcaaaaaggttaccgaggtgaaagggtacacaaagggaggccccgggcatgaagagcctattcccatggccacctacggatggaaccttgtgaaactgcacagcggcaaggacgtctttttcacacctccggaaaagtgtgataccctgctctgcgacatcggggagtcctctcccaatcctacgattgaggaaggacggaccctgagagtgcttaaaatggttgagccctggctgcgcggcaaccaattttgtatcaagattctcaatccttatatgcccagcgtggtcgaaacactggagcagatgcagcggaaacacggcgggatgctggtgagaaacccgctctcccgcaattctacccatgagatgtactgggttagctgcggaacaggcaacatcgtgtccgcggtcaatatgaccagccggatgctgcttaacagattcacaatggcccaccgcaagcctacctatgaacgggatgtggacctgggggctggaacgagacatgtggccgtcgagcccgaagttgctaacctcgatattatcggccagcgcatcgagaatattaaaaacgaacacaagtctacatggcactacgacgaggataatccctataagacctgggcctaccatgggtcctatgaggtgaaacctagcggatctgcgtccagcatggtgaacggcgtcgtgagactgcttaccaagccctgggacgttatccctatggtgacacaaattgccatgacggacaccacaccgtttggccagcagcgggtcttcaaagaaaaggtggatacccgcacacccagagctaaacgggggaccgcccaaatcatggaggttacagctaagtggctgtggggatttctctctagaaataagaaacctcggatttgtacccgcgaagagttcacgagaaaggtgcggtccaacgccgctatcggcgccgtctttgtggacgaaaatcagtggaacagcgcgaaagaggccgttgaggatgaacgcttctgggacctggtgcacagagagcgggaactgcataagcaggggaaatgcgctacctgcgtctacaatatgatgggaaagcgcgagaagaaactcggcgaatttgggaaggccaaaggctccagagctatctggtacatgtggctgggagcccggttccttgagttcgaggccctgggctttatgaacgaagatcactggttcagccgcgagaattctctcagcggggtggaaggagagggcctgcataagcttgggtatattctgagagacatctccaaaattcccggaggcaacatgtacgcggatgacacagctgggtgggatacccggatcacagaggacgatctccagaatgaagccaagattaccgacatcatggagcctgaacacgccctgctggctacgtctatctttaaactcacatatcaaaacaaggtcgtgcgcgttcagagacccgccaagagcggcaccgtgatggatgtcatttcccggcgcgaccagagaggatctggccaggtggggacatacggactgaataccttcacgaacatggaggtgcaacttatccggcagatggaaagcgagggcattttttccccgtctgagctggaaacccctaacctcgctaaaaaggttctggactggcttgagaaacacggggccgaaagactgaagcgcatggcgatcagcggagatgactgtgtggtcaaacccattgatgaccggttcgccacagctctcaccgccctgaatgatatgggcaaggtgagaaaggacatccctcagtgggagccctccaaagggtggaacgattggcagcaagttcctttttgcagccatcacttccatcagctgatcatgaaggacggccgcgaaattgtggtcccctgtcggaatcaggatgagctcgtgggaagagctcgcgtctctcagggcgccgggtggtccctgcgggagacagcgtgccttggaaaaagctatgcccaaatgtggcagctgatgtactttcacagacgcgacctccggctggctgccaacgctatctgttctgccgtgccggttgattgggtgcctacctccagaacaacctggagcattcacgctcatcaccagtggatgacgacagaagacatgctttccgtctggaatcgcgtgtggatcgaggaaaacccctggatggaggacaagacccatgtttctagctgggaagaggtgccctatctgggcaaacgggaggatcaatggtgcgggtccctcattggactgaccgccagagcgacatgggccaccaatatccaggtcgctattaaccaggtgcggagactgatcggcaatgaaaactacctcgactacatgacaagcatgaagcgcttcaagaatgagtctgatcctgaaggggccctgtggtga

SEQ ID NO: 18506 - RNA, 9879 nt, synthetic construct
  misc_feature 1..9879: note = derived and/or modified CDS sequence (opt5) from DENV-1__GQ868559__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatacgtgtatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacacctgacactcagagcccagaacgctcttgataatctggtgatgctgcacaactccgaacagggaggcaaggcctaccggcatgcgatggaggaactccccgacaccattgagaccctgatgcttctggccctcatcgctgtcctgacaggcggggttaccctgtttttcctctctggaaagggccttgggaaaacaagcatcggactgctgtgtgtgacggcctcctctgctctcctgtggatggccagcgtggagccgcactggattgccgcttccatcattcttgaatttttcctgatggtcctcctgatccctgagcccgatcgccagagaacccctcaagacaatcagctggcgtatgtggttattggcctcctttttatgatcctgacagtggccgctaacgaaatggggctgctcgagaccacaaagaaagatctgggaatcggctacgtcgccgccgagaaccatcagcacgctaccatgcttgacgtggatctgcggcccgccagcgcgtggacgctctacgccgtcgctaccacagtgattacccctatgatgcgccacacaatcgaaaataccacggccaacatttctctgacagctatcgccaatcaagcggccattctgatgggcctcgacaaggggtggcccatctccaaaatggatattggagttccgcttctggctctgggctgctatagccaggtgaaccctctcaccctgacagccgctgtccttatgctggtggcccattacgctatcatcgggcccggactccaggccaaggcgaccagagaggcccagaagcggaccgctgccggcattatgaaaaatcccacagttgacgggatcgtggctattgatctggaccctgtcgtgtatgacgccaagttcgaaaaacaactgggacagatcatgctccttattctgtgtacgtctcagatcctgctcatgcgcaccacatgggccctgtgcgagtccatcacccttgcgacaggcccgctgaccacgctctgggaaggcagccccgggaagttttggaacacaaccattgctgtgtctatggccaatatcttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaattatggaggttgatagatccgaagccaaagagggcctgaagcgcggggaaacaacgaaacacgcggtctctcggggaaccgccaagcttagatggttcgtggagcgcaacctggtgaagcctgagggcaaagtcatcgacctcgggtgtggacggggcggctggagctactattgcgctgggctgaagaaagttacagaagtgaagggatacaccaaaggcgggcccggacatgaggaacctattcccatggccacatacggctggaatctggtgaagctccactccgggaaagatgtctttttcatgcctccggagaagtgtgacacccttctgtgcgatatcggagaatctagccccaaccctacgatcgaggagggcagaaccctgcgcgtgctcaagatggttgaaccctggctgcggggcaatcagttttgtattaaaatccttaacccttatatgccctccgtggtcgagacactggaacagatgcaaagaaagcatgggggaatgctcgtgcgcaatccgctgtctcggaacagcacccacgagatgtactgggtttcctgcggcacagggaatattgtgagcgctgtcaacatgacctctagaatgctgctcaaccgcttcacaatggcccaccggaaacctacctatgagagagacgtggatctgggagcgggcacgcgccatgtggccgtcgaacccgaggaagctaatcttgacatcattgggcagagaatcgagaacattaagaatgaacacaaatccacatggcattacgatgaggacaacccctataagacctgggcctaccacggaagctatgaggttaagccttctggctccgctagctctatggtgaatggcgtggtccggctgctcaccaaaccctgggatgtgatccctatggttacacagatcgccatgacggacaccacaccgtttgggcaacagcgcgtgttcaaggaaaaagtcgacaccagaacaccccgggctaagagaggaaccacacagattatggaggtgaccgccaaatggctgtggggctttctttcccggaacaagaagcctcgcatctgtacgagagaagagttcacccggaaagttcgcagcaatgcggccattggggctgtgtttgtcgatgaaaaccagtggaattccgccaaggaggctgtggaggacgaaagattctgggatctggttcaccgggagcgcgaactccataaacaaggaaagtgcgccacatgcgtgtacaacatgatgggcaaaagagagaagaagctgggggaatttggcaaagccaagggaagccgggcgatctggtacatgtggctgggcgctcgcttcctcgagttcgaggccctggggtttatgaatgaagaccactggttctctagagagaacagcctttccggagtcgaaggcgaggggctgcataaactcggatatattctgcgggatatctctaagatccccggcgggaatatgtacgccgacgataccgctggctgggacacacgcattaccgaggatgaccttcagaacgaagccaaaatcacggatattatggagcctgaacacgctctgctcgccacaagcatctttaagctgacctatcagaataaagtggtcagagtgcagcggcccgcgaagaacggaacagttatggacgtgatttcccgcagagatcaacggggctctgggcaggtcggaacctacggcctgaacacgttcaccaatatggaggtgcagctcatcagacagatggaaagcgaggggatctttctgccgtccgagcttgaaacacctaacctggccgagcgcgtgctcgactggctggaaaagcatggagctgagcggcttaaaagaatggccatttctggcgacgattgtgttgtgaagcccatcgacgatcgcttcgctaccgccctgacagcgctcaatgacatggggaaagtccggaaggatattcctcaatgggaacccagcaaaggctggaacgactggcagcaggtgcctttttgctcccaccacttccatcagctgatcatgaaggatggaagagagattgttgtgccctgtcgcaatcaagacgagctggtcggccgggccagagtgagccagggggctggatggtctctccgcgaaaccgcctgcctgggcaagtcctatgctcagatgtggcaacttatgtactttcaccggagagatctgcgcctcgccgctaacgccatctgtagcgcggtcccggtggactgggttcctacatctcggaccacgtggtccatccatgcccaccaccagtggatgacaaccgaggatatgctgagcgtgtggaatagagtctggattgaagagaacccctggatggaagacaaaacccatgtgtcctcttgggaggaggttccctatcttgggaagcgggaagaccagtggtgcggaagcctgatcggcctcacagctagagccacctgggccacaaatattcaggtggctatcaaccaagtccgccggctgattgggaatgagaactacctggattacatgacgtccatgaaaagattcaagaatgaaagcgaccctgagggcgccctctggtga

SEQ ID NO: 18507 - RNA, 9879 nt, synthetic construct
  misc_feature 1..9879: note = derived and/or modified CDS sequence (opt5) from DENV-1__GQ868560__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcattaagaaagacctcatctcctacggcggcgggtggagattccagggaagctggaacacaggcgaggaggtgcaagtgattgccgttgaacctgggaagaatcccaaaaacgtccagacgaccccgggaacatttaagacccctgagggcgaagtgggggctatcgccctggatttcaagcccggaacctctggctcccctattgtgaatcgcgagggcaaaatcgtcgggctctacggaaacggcgtggttacaacgagcgggacctatgtgtctgcgattgctcaggccaaggcctcccaagaaggacccctgcccgagatcgaggacgaagtctttaaaaagcggaatcttacaatcatggatctgcaccctggcagcgggaaaaccagacgctacctgccggctattgtgcgggaggccatcaagagaaagctccgcacactgattcttgcgcccacccgggttgtggcttccgaaatggccgaggccctgaaaggcatgcctatcagatatcagacgacagctgtcaagtctgaacataccggacgcgagattgtggacctcatgtgccacgccaccttcacaatgcggctgctgagccccgttagagtgcctaactacaatatgatcatcatggatgaggctcattttaccgaccccgcctccattgcggcccggggctatatcagcacacgcgtcgggatgggagaagctgccgctattttcatgaccgccacgcctccgggctctgtggaggcctttccccagtccaacgctgtgatccaggatgaagagagagacattcctgaacggagctggaattctgggtacgattggatcacagacttccccggaaaaaccgtctggtttgttcctagcatcaagtccggcaacgatattgcgaattgtctccgcaaaaacgggaagagagtgatccaactttctcggaagacattcgacaccgagtatcagaaaacgaagaacaatgactgggattacgtggtcaccacagacattagcgagatgggcgccaacttcagagctgatcgcgtgatcgacccccggagatgcctgaaaccggttattctgaaggatggacctgaacgcgtgatcctcgccggccccatgcccgtcaccgtggcctccgctgcccagcggagagggcgcattggacggaatcagaacaaagagggcgaccaatacgtttatatggggcagcctctgaataacgatgaagaccacgcgcattggacagaggctaagatgcttctggataatatcaacacccccgagggaatcattcctgccctctttgaaccggagagagaaaagtctgccgctatcgacggcgagtaccgcctgagaggggaagcccggaaaacattcgtggagctgatgcgcagaggcgatctccccgtctggcttagctataaggtggcgtccgagggatttcagtacagcgaccggcgctggtgcttcgatggcgaaagaaataaccaggtcctggaggaaaatatggacgtggagatttggaccaaagaaggggagcggaagaaactgagacctcgctggctcgacgcccggacgtattctgatcccctggctcttagagagtttaaggaattcgccgctggacgccggtccgttagcggcgacctgatcctcgagattgggaaactgcctcaacacctgacactcagagcccagaacgctcttgataatctggtgatgctgcacaactccgaacagggaggcaaggcctaccggcatgcgatggaggaactccccgacaccatcgagaccctgatgcttctggccctcatcgctgtgctgacaggcggggtcaccctgtttttcctctctggaaagggccttgggaaaacaagcattggactgctgtgtgttacggcctcctctgctctcctgtggatggccagcgtggagccgcactggatcgccgcttccattatccttgaatttttcctgatggtgctcctgattcctgagcccgatcgccagagaacccctcaagacaatcagctggcgtatgtcgtgatcggcctcctttttatgatcctgacagttgccgctaacgaaatggggctgctcgagaccacaaagaaagatctgggaattggctacgtggccgccgagaaccatcagcacgctaccatgcttgacgtcgatctgcggcccgccagcgcgtggacgctctacgccgtggctaccacagtcatcacccctatgatgcgccacacaattgaaaataccacggccaacatctctctgacagctattgccaatcaagcggccatcctgatgggcctcgacaaggggtggcccatttccaaaatggatatcggagtgccgcttctggctctgggctgctatagccaggttaaccctctcaccctgacagccgctgtgcttatgctggtcgcccattacgctatcattgggcccggactccaggccaaggcgaccagagaggcccagaagcggaccgctgccggcatcatgaaaaatcccacagtggacgggattgttgctatcgatctggaccctgtggtctatgacgccaagttcgaaaaacaactgggacagattatgctccttatcctgtgtacgtctcagatcctgctcatgcgcaccacatgggccctgtgcgagtccattacccttgcgacaggcccgctgaccacgctctgggaaggcagccccgggaagttttggaacacaaccatcgctgtgtctatggccaatattttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaatcatggaggtggatagatccgaagccaaagagggcctgaagcgcggggaaacaacgaaacacgcggtttctcggggaaccgccaagcttagatggttcgtcgagcgcaacctggtgaagcctgagggcaaagtgattgacctcgggtgtggacggggcggctggagctactattgcgctgggctgaagaaagtcacagaagttaagggatacaccaaaggcgggcccggacatgaggaacctatccccatggccacatacggctggaatctggtgaagctccactccgggaaagatgtgtttttcatgcctccggagaagtgtgacacccttctgtgcgatatcggagaatctagccccaaccctacgattgaggagggcagaaccctgcgcgtcctcaagatggtggaaccctggctgcggggcaatcagttttgtatcaaaattcttaacccttatatgccctccgttgtggagacactggaacagatgcaaagaaagcatgggggaatgctcgtccgcaatccgctgtctcggaacagcacccacgagatgtactgggtgtcctgcggcacagggaatatcgttagcgctgtgaacatgacctctagaatgctgctcaaccgcttcacaatggcccaccggaaacctacctatgagagagacgtcgatctgggagcgggcacgcgccatgtggccgtggaacccgaggaagctaatcttgacattatcgggcagagaattgagaacatcaagaatgaacacaaatccacatggcattacgatgaggacaacccctataagacctgggcctaccacggaagctatgaggtcaagccttctggctccgctagctctatggttaatggcgtggtgcggctgctcaccaaaccctgggatgtcatccctatggtgacacagattgccatgacggacaccacaccgtttgggcaacagcgcgttttcaaggaaaaagtggacaccagaacaccccgggctaagagaggaaccacacagatcatggaggtcaccgccaaatggctgtggggctttctttcccggaacaagaagcctcgcatttgtacgagagaagagttcacccggaaagtgcgcagcaatgcggccatcggggctgtttttgtggatgaaaaccagtggaattccgccaaggaggctgtcgaggacgaaagattctgggatctggtgcaccgggagcgcgaactccataaacaaggaaagtgcgccacatgcgtttacaacatgatgggcaaaagagagaagaagctgggggaatttggcaaagccaagggaagccgggcgatttggtacatgtggctgggcgctcgcttcctcgagttcgaggccctggggtttatgaatgaagaccactggttctctagagagaacagcctttccggagtggaaggcgaggggctgcataaactcggatatatcctgcgggatatctctaagattcccggcgggaatatgtacgccgacgataccgctggctgggacacacgcatcaccgaggatgaccttcagaacgaagccaaaattacggatatcatggagcctgaacacgctctgctcgccacaagcatttttaagctgacctatcagaataaagtcgtgagagtccagcggcccgcgaagaacggaacagtgatggacgttatctcccgcagagatcaacggggctctgggcaggtgggaacctacggcctgaacacgttcaccaatatggaggtccagctcatcagacagatggaaagcgaggggatttttctgccgtccgagcttgaaacacctaacctggccgagcgcgtgctcgactggctggaaaagcatggagctgagcggcttaaaagaatggccatctctggcgacgattgtgtggttaagcccattgacgatcgcttcgctaccgccctgacagcgctcaatgacatggggaaagtgcggaaggatatccctcaatgggaacccagcaaaggctggaacgactggcagcaggtccctttttgctcccaccacttccatcagctgattatgaaggatggaagagagatcgtggttccctgtcgcaatcaagacgagctggtgggccgggccagagtcagccagggggctggatggtctctccgcgaaaccgcctgcctgggcaagtcctatgctcagatgtggcaacttatgtactttcaccggagagatctgcgcctcgccgctaacgccatctgtagcgcggtgccggtcgactgggtgcctacatctcggaccacgtggtccattcatgcccaccaccagtggatgacaaccgaggatatgctgagcgtttggaatagagtgtggatcgaagagaacccctggatggaagacaaaacccatgtctcctcttgggaggaggtgccctatcttgggaagcgggaagaccagtggtgcggaagcctgattggcctcacagctagagccacctgggccacaaatatccaggttgctattaaccaagtgcgccggctgatcgggaatgagaactacattgattacatgacgtccatgaaaagattcaagaatgaaagcgaccctgagggcgccctgtggtga

SEQ ID NO: 18508 - RNA, 9879 nt, synthetic construct
  misc_feature 1..9879: note = derived and/or modified CDS sequence (opt5) from DENV-1__GQ868561__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagagcaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaaggggatgtcctatgtgatgtgtacgggcagcttcaaactggagaaggaagtcgccgagacacagcacggaaccgtgctggttcaggtgaagtacgagggcaccgatgcgccgtgcaaaattcctttttctacacaagacgaaaagggggtcacccagaacggacggcttatcacagctaatcccatcgtgacggataaagagaagcctgtgaacattgaaaccgagccccccttcggcgagtcctatatcgttgtcggggccggagaaaaagccctcaagctgagctggtttaagaaaggctctagcattgggaagatgttcgaggctacagccagaggcgctcgccggatggccatcctgggagacaccgcgtgggattttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctgtccgccgcgattggcaaggcctgggaggagggggtgtgcggcatcagatctgctacgcgcctcgaaaatattatgtggaaacagatcagcaacgagctgaatcatatccttctggaaaacgacatgaagtttacagtcgtggtgggagacgccaatggcattctcgctcaggggaaaaagatgatccggccgcaacccatggagcacaaatactcctggaagtcttggggaaaggccaaaattatcggcgccgatattcagaacaccaccttcatcatcgacgggcctgatacacccgaatgtcctgacggacagagagcttggaatatttgggaggtcgaggattatggctttggcatcttcaccacgaacatttggctgaagctgcgcgacagctacacacagatgtgcgatcaccggcttatgtccgcggccatcaaagacagcaaggctgttcatgccgatatggggtattggattgaatctgagaaaaatgaaacctggaagctcgccagagcttccttcatcgaggtgaagacatgtacctggcccaaaagccacacactgtggtctaacggagtgctggaatccgagatgatcattccgaagatctacggcgggcctattagccaacataattatcgccccggatactttacccagacggccggcccttggcacctcgggaaactggagcttgacttcgatctgtgcgaaggaaccacagtcgtggttgacgagcactgcggcaaccggggcccctctctcagaaccacaaccgtgacggggaagatcattcatgaatggtgttgccggagctgtacactgcctcccctgcgctttagaggagaggatggctgctggtacgggatggagatccggccggtcaaagaaaaggaggaaaatcttgtgagatccatggttagcgcgggatctggcgaggtggactccttcagcctcgggatcctgtgtgtctccattatgatcgaagaggtgatgcgctctcggtggagcagaaagatgctgatgaccggaacactcgctgtttttctgcttctgattatgggccagctcacctggaacgacctgatccgcctgtgcattatggtgggcgccaatgcctccgatagaatggggatgggaaccacatatcttgctctgatggccacgttcaaaatgcggcctatgtttgcggtcggcctcctgttccgcagactcacctctcgggaggtgctgcttctgacaatcgggctcagcctggtggcttccgtcgaactgcccaactctcttgaggaactgggagacggcctcgccatggggattatgatgctgaagctcctgaccgagtttcaaccccaccagctttggacaaccctgctcagcctgacgttcgttaaaacaaccctgtcccttgattacgcctggaagaccacagctatggtgctgagcatcgtgtctctctttcctctgtgtctctccaccacaagccagaaaacgacctggctgccggtccttctgggatctttcggctgcaagcccctgacaatgtttctcatcaccgaaaacaagatttggggccgcaaatcctggcctctgaatgaggggatcatggccattggaatcgtgagcattcttctgtcttccctcctgaagaacgacgttcccctcgctggccctctgatcgccgggggaatgcttatcgcgtgttatgtgattagcggctccagcgccgatctgtctctggagaaagctgccgaagtcagctgggagcaggaagctgagcattccggggcctctcacaatatcctcgtggaagttcaagacgatggaacaatgaagattaaagacgaggagagagatgacaccctgacgatccttctgaaggccaccctcctggctgtgagcggcgtctaccccatgtccattcctgcgacactcttcgtgtggtatttctggcagaaaaagaagcagcggtctggcgtcctgtgggatacccccagcccgcctgaagtggagcgcgccgttcttgacgatgggatctacagaatcctgcagcggggactgctcggccgctcccaagtgggggtcggagtgtttcaggacggcgttttccatacaatgtggcacgtgaccagaggggctgtcctgatgtatcagggaaaacggcttgaaccctcttgggccagcgtgaagaaagacctgatttcctacggcggcgggtggagatttcagggaagctggaacacaggcgaggaggtgcaagttatcgccgtcgaacctgggaagaatcccaaaaacgtgcagacgaccccgggaacattcaagacccctgagggcgaagtgggggctattgccctcgattttaagcccggaacctctggctcccctatcgtcaatcgcgagggcaaaattgtggggctgtacggaaacggcgttgtgacaacgagcgggacctatgtctctgcgatcgctcaggccaaggcctcccaagaaggacccctccccgagattgaggacgaagtgttcaaaaagcggaatctgacaatcatggatcttcaccctggcagcgggaaaaccagacgctacctgccggctatcgttcgggaggccattaagagaaagctgcgcacactcatcctggcgcccacccgggtggtcgcttccgaaatggccgaggcccttaaaggcatgcctattagatatcagacgacagctgtgaagtctgaacataccggacgcgagatcgttgacctgatgtgccacgccacctttacaatgcggctcctgagccccgtgagagtccctaactacaatatgattatcatggatgaggctcatttcaccgaccccgcctccatcgcggcccggggctatattagcacacgcgtggggatgggagaagctgccgctatctttatgaccgccacgcctccgggctctgtggaggccttcccccagtccaacgctgtcattcaggatgaagagagagacatccctgaacggagctggaattctgggtacgattggattacagactttcccggaaaaaccgtttggttcgtgcctagcatcaagtccggcaacgatatcgcgaattgtctgcgcaaaaacgggaagagagtgattcaactctctcggaagacattcgacaccgagtatcagaaaacgaagaacaatgactgggattacgtcgtgaccacagacatcagcgagatgggcgccaactttagagctgatcgcgttattgacccccggagatgccttaaaccggtgatcctgaaggatggacctgaacgcgtcattctggccggccccatgcccgtgaccgttgcctccgctgcccagcggagagggcgcatcggacggaatcagaacaaagagggcgaccaatacgtgtatatggggcagcctctcaataacgatgaagaccacgcgcattggacagaggctaagatgctgcttgataatattaacacccccgagggaatcatccctgccctgttcgaaccggagagagaaaagtctgccgctattgacggcgagtaccgcctcagaggggaagcccggaaaacatttgtcgagctgatgcgcagaggcgatctgcccgtgtggctcagctataaggtcgcgtccgagggattccagtacagcgaccggcgctggtgctttgatggcgaaagaaataaccaggtgcttgaggaaaatatggacgttgagatctggaccaaagaaggggagcggaagaaactgagacctcgctggctggacgcccggacgtattctgatcccctcgctctgagagagttcaaggaatttgccgctggacgccggtccgtgagcggcgaccttattctggagatcgggaaactccctcaacacctgacactgagagcccagaacgctctcgataatcttgtgatgctgcacaactccgaacagggaggcaaggcctaccggcatgcgatggaggaactgcccgacaccattgagaccctcatgctgcttgccctgatcgctgtcctcacaggcggggttaccctgttctttctgtctggaaagggcctcgggaaaacaagcatcggacttctgtgtgtgacggcctcctctgctctgctctggatggccagcgtggagccgcactggattgccgcttccatcattctggaattctttcttatggtcctgctcatccctgagcccgatcgccagagaacccctcaagacaatcagctggcgtatgtggttattggcctgctcttcatgatccttacagtggccgctaacgaaatggggctgctggagaccacaaagaaagatctcggaatcggctacgtcgccgccgagaaccatcagcacgctaccatgctggacgtggatcttcggcccgccagcgcgtggacgctgtacgccgtcgctaccacagtgattacccctatgatgcgccacacaatcgaaaataccacggccaacatttctctcacagctatcgccaatcaagcggccattctgatgggcctggacaaggggtggcccatctccaaaatggatattggagttccgctccttgctctgggctgctatagccaggtgaaccctctgaccctcacagccgctgtcctgatgcttgtggcccattacgctatcatcgggcccggactgcaggccaaggcgaccagagaggcccagaagcggaccgctgccggcattatgaaaaatcccacagttgacgggatcgtggctattgatctcgaccctgtcgtgtatgacgccaagtttgaaaaacaactgggacagatcatgctgctcattctttgtacgtctcagatcctgctgatgcgcaccacatgggccctctgcgagtccatcaccctggcgacaggcccgcttaccacgctgtgggaaggcagccccgggaagttctggaacacaaccattgctgtgtctatggccaatatcttcagaggaagctacctcgctggcgccgggctggccttttccctgatgaaatctctcggaggcgggcggcgcggaaccggcgctcagggcgagacacttggggagaagtggaagagacaactgaaccagctgagcaaatccgaattcaatacctataagcggagcggaattatggaggttgatagatccgaagccaaagagggcctcaagcgcggggaaacaacgaaacacgcggtctctcggggaaccgccaagctgagatggtttgtggagcgcaaccttgtgaagcctgagggcaaagtcatcgacctggggtgtggacggggcggctggagctactattgcgctgggctcaagaaagttacagaagtgaagggatacaccaaaggcgggcccggacatgaggaacctattcccatggccacatacggctggaatctggtgaagctgcactccgggaaagatgtcttctttatgcctccggagaagtgtgacaccctcctttgcgatatcggagaatctagcccctcccctacgatcgaggagggcagaaccctgcgcgtgctgaagatggttgaaccctggctccggggcaaccagttctgtattaaaatcctgaatccttatatgccctctgtggtcgagacacttgaacagatgcaaagaaagcatgggggaatgctggtgcgcaacccgctcagccggaattccacccacgagatgtactgggttagctgcggcacagggaacattgtgtctgctgtcaatatgacctccagaatgctgctgaaccgctttacaatggcccaccggaaacctacctatgagagagacgtggatctcggagcgggcacgcgccatgtggccgtcgaacccgaggttgctaacctggacatcattgggcagagaatcgaaaatattaagaacgagcacaaaagcacatggcattacgatgaagacaatccctataagacctgggcctaccacggatcttatgaggtgaagccttccggcagcgcttcttccatggtgaacggcgtcgtgcggcttctgaccaaaccctgggatgttatccctatggtgacacagatcgccatgacggacaccacaccgttcgggcaacagcgcgtctttaaggagaaagtggacaccagaacaccccgggctaagagaggaaccacacagattatggaagttaccgccaaatggctctggggcttcctgagccggaataagaagcctcgcatctgtacgagagaggaatttacccggaaagtgcgctccaacgcggccattggggctgtcttcgtggatgagaatcagtggaacagcgccaaggaagctgttgaggacgagagattttgggatcttgtgcaccgggaacgcgagctgcataaacaaggaaagtgcgccacatgcgtctacaatatgatgggcaaaagagaaaagaagctcggggagttcggcaaagccaagggatctcgggcgatctggtacatgtggctgggcgctcgcttcctggaatttgaggccctcgggttcatgaacgaggaccactggtttagcagagaaaattccctgtctggagtggagggcgaagggcttcataaactgggatatattctccgggatatcagcaagatccccggcgggaacatgtacgccgacgataccgctggctgggacacacgcattaccgaggatgacctgcagaatgaggccaaaatcacggatattatggaacctgagcacgctcttctggccacatccatcttcaagctcacctatcagacaaaagtcgtgagagttcagcggcccgcgaagaacggaaccgtgatggacgtcatttctcgcagagatcaacggggcagcgggcaggtgggaacgtacggcctgaatacctttacaaacatggaagtgcagctgatcagacagatggagtccgaagggatcttcctcccgtctgagctggagacccctaaccttgccgaacgcgttctggactggctcgagaagcatggagctgaacggctgaaaagaatggccattagcggcgacgattgtgtggtcaagcccatcgacgatcgctttgctacagcccttaccgcgctgaatgacatggggaaagtgcggaaggatattcctcaatgggagccctccaaaggctggaacgactggcagcaggttcctttctgcagccaccactttcatcagctcatcatgaaggatggaagagaaattgtggtcccctgtcgcaatcaagacgagctggtgggccgggccagagtctctcagggggctggatggtccctgcgcgagacagcctgcctcggcaagagctatgctcagatgtggcaactgatgtacttccaccggagagatcttcgcctggccgctaacgccatctgttctgcggtgccggttgactgggtgcctacctcccggacgacatggagcatccatgcccaccaccagtggatgaccaccgaagatatgctctccgtctggaatagagtgtggattgaggaaaacccctggatggaggacaaaacacatgtttctagctgggaagaggtgccctatctggggaagcgggaggaccagtggtgcggatcccttatcggcctgaccgctagagccacatgggccacgaatattcaggtcgctatcaaccaagtgcgccggctcattgggaatgaaaactacctggattacatgaccagcatgaaaagatttaagaatgagtctgaccctgaaggcgccctgtggtga

SEQ ID NO: 18509 - RNA, 9879 nt, synthetic construct
  misc_feature 1..9879: note = derived and/or modified CDS sequence (opt5) from DENV-1__GU131948__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggagatccttctgctcacaattgggctgagcctggtggcttccgtggaacttcccaactctctggaggaactcggagacggcctggccatggggatcatgatgctcaagctgcttaccgagttccaaccccaccagctgtggacaaccctcctgagcctgacgtttgtcaaaacaaccctttccctggattacgcctggaagaccacagctatggttctcagcatcgtgtctctgttccctctctgtctgtccaccacaagccagaaaacgacctggcttccggtgctgctgggatcttttggctgcaagcccctcacaatgttcctgattaccgaaaacaagatctggggccgcaaatcctggcctcttaatgaggggattatggccatcggaattgtcagcatcctgctctcttccctgctcaagaacgacgtgcccctggctggccctcttatcgccgggggaatgctgattgcgtgttatgttatcagcggctccagcgccgatctgtctctcgagaaagctgccgaagtgagctgggagcaggaagctgagcattccggggcctctcacaatattctggtcgaagtgcaagacgatggaacaatgaagatcaaagacgaggagagagatgacacccttacgattctgctcaaggccaccctgctcgctgttagcggcgtgtaccccatgtccatccctgcgacactgtttgtctggtatttctggcagaaaaagaagcagcggtctggcgtgctttgggatacccccagcccgcctgaagtcgagcgcgccgtgctggacgatgggatctacagaattctgcagcggggactcctgggccgctcccaagttggggtgggagtcttccaggacggcgtgtttcatacaatgtggcacgttaccagaggggctgtgcttatgtatcagggaaaacggctggaaccctcttgggccagcgtcaagaaagacctcatctcctacggcggcgggtggagattccagggaagctggaacacaggcgaggaggtgcaagtgattgccgttgaacctgggaagaatcccaaaaacgtccagacgaccccgggaatctttaagacacctgagggcgaagtgggggctattgccctggatttcaagcccggaacctctggctcccctatcgtgaatcgcgagggcaaaattgtcgggctctacggaaacggcgtggttaccacaagcgggacgtatgtgtctgcgatcgctcaggccaaggcctcccaagaaggacccctgcccgagatcgaggacgaagtctttaaaaagcggaatcttaccattatggatctgcaccctggcagcgggaaaacaagacgctacctgccggctatcgtgcgggaggccattaagagaaagctccgcaccctgatccttgcgcccacacgggttgtggcttccgaaatggccgaggccctgaaaggcatgcctattagatatcagaccacggctgtcaagtctgaacatacaggacgcgagatcgtggacctcatgtgccacgccaccttcaccatgcggctgctgagccccgttagagtgcctaactacaatatgatcattatggatgaggctcattttacagaccccgcctccatcgcggcccggggctatattagcacccgcgtcgggatgggagaagctgccgctatcttcatgacagccacccctccgggctctgtggaggcctttccccagtccaacgctgtgattcaggatgaagagagagacatccctgaacggagctggaattctgggtacgattggatcacggacttccccggaaaaacagtctggtttgttcctagcattaagtccggcaacgatatcgcgaattgtctccgcaaaaacgggaagagagtgattcaactttctcggaagaccttcgacacagagtatcagaaaaccaagaacaatgactgggattacgtggtcacgaccgacatcagcgagatgggcgccaacttcagagctgatcgcgtgattgacccccggagatgcctgaaaccggttatcctgaaggatggacctgaacgcgtgattctcgccggccccatgcccgtcacagtggcctccgctgcccagcggagagggcgcatcggacggaatcagaacaaagagggcgaccaatacgtttatatggggcagcctctgaataacgatgaagaccacgcgcattggaccgaggctaagatgcttctggataatatcaacacacccgagggaattatccctgccctctttgaaccggagagagaaaagtctgccgctattgacggcgagtaccgcctgagaggggaagcccggaaaaccttcgtggagctgatgcgcagaggcgatctccccgtctggcttagctataaggtggcgtccgagggatttcagtacagcgaccggcgctggtgcttcgatggcgaaagaaataaccaggtcctggaggaaaatatggacgtggagatctggacaaaagaaggggagcggaagaaactgagacctcgctggctcgacgcccggacctattctgatcccctggctcttagagagtttaaggaattcgccgctggacgccggtccattagcggcgacctgatcctcgagatcgggaaactgcctcaacacctgacgctcagagcccagaacgctcttgataatctggttatgctgcacaactccgaacagggaggcaaggcctaccggcatgcgatggaggaactccccgacacaattgagaccctgatgcttctggccctcatcgctgtgctgaccggcggggtgacactgtttttcctctctggaaagggccttgggaaaaccagcattggactgctgtgtgtcacagcctcctctgctctcctgtggatggccagcgttgagccgcactggatcgccgcttccattatccttgaatttttcctgatggtgctcctgatccctgagcccgatcgccagagaacgcctcaagacaatcagctggcgtatgtggtcattggcctcctttttatgatcctgaccgtggccgctaacgaaatggggctgctcgagacaaccaagaaagatctgggaattggctacgttgccgccgagaaccatcagcacgctacaatgcttgacgtggatctgcggcccgccagcgcgtggaccctctacgccgtcgctacgaccgtgatcacacctatgatgcgccacaccattgaaaatacaaccgccaacatctctctgacggctattgccaatcaagcggccatcctgatgggcctcgacaaggggtggcccatctccaaaatggatattggagtcccgcttctggctctgggctgctatagccaggtgaaccctctcacactgaccgccgctgttcttatgctggtggcccattacgctatcattgggcccggactccaggccaaggcgacaagagaggcccagaagcggaccgctgccggcatcatgaaaaatcccaccgtcgacgggattgtggctatcgatctggaccctgttgtgtatgacgccaagttcgaaaaacaactgggacagatcatgctccttattctgtgtacatctcagatcctgctcatgcgcacgacctgggccctgtgcgagtccattacacttgcgaccggcccgctgacaaccctctgggaaggcagccccgggaagttttggaacacgacaatcgctgtctctatggccaatattttcagaggaagctacctggctggcgccgggctggccttctccctcatgaaatctcttggaggcgggcggcgcggaaccggcgctcagggcgagaccctgggggagaagtggaagagacaactgaaccagctcagcaaatccgaatttaatacatataagcggagcggaatcatggaggtggatagatccgaagccaaagagggcctgaagcgcggggaaaccacaaaacacgcggtgtctcggggaacggccaagcttagatggttcgttgagcgcaacctggtcaagcctgagggcaaagtgatcgacctcgggtgtggacggggcggctggagctactattgcgctgggctgaagaaagtgaccgaagtcaagggatacacaaaaggcgggcccggacatgaggaacctattcccatggccacctacggctggaatctggttaagctccactccgggaaagatgtgtttttcatgcctccggagaagtgtgacacacttctgtgcgatatcggagaatctagccccaaccctaccattgaggagggcagaacgctgcgcgtgctcaagatggtcgaaccctggctgcggggcaatcagttttgtatcaaaattcttaacccttatatgccctccgtggttgagaccctggaacagatgcaaagaaagcatgggggaatgctcgtgcgcaatccgctgtctcggaacagcacacacgagatgtactgggtctcctgcggcaccgggaatatcgtgagcgctgttaacatgacatctagaatgctgctcaaccgcttcaccatggcccaccggaaacctacatatgagagagacgtggatctgggagcgggcacccgccatgtcgccgtggaacccgaggtggctaatcttgacattatcgggcagagaatcgaaaacattaagaatgagcacaaatccacgtggcattacgatgaagacaacccctataagacatgggcctaccacggaagctatgaggtcaagccttctggctccgctagctctatggttaatggcgtggtgcggctgctcaccaaaccctgggatgtcatccctatggtgacccagattgccatgacagacacgaccccgtttgggcaacagcgcgttttcaaggagaaagtggacacaagaaccccccgggctaagagaggaacaacccagatcatggaagtcacagccaaatggctgtggggctttctttcccggaacaagaagcctcgcatttgtaccagagaggaattcacgcggaaagtgcgcagcaatgcggccatcggggctgtttttgtggatgagaaccagtggaattccgccaaggaagctgtcgaggacgagagattctgggatctggtgcaccgggaacgcgagctccataaacaaggaaagtgcgccacctgcgtttacaacatgatgggcaaaagagaaaagaagctgggggagtttggcaaagccaagggaagccgggcgatctggtacatgtggctgggcgctcgcttcctcgaattcgaggccctggggtttatgaatgaggaccactggttctctagagaaaacagcctttccggagtggagggcgaagggctgcataaactcggatatattctgcgggatatctctaagattcccggcgggaatatgtacgccgacgatacagctggctgggacacccgcatcacagaggatgaccttcagaacgaggccaaaattaccgatatcatggaacctgagcacgctctgctcgccacgagcatctttaagctgacatatcagaataaagtcgtgagagtccagcggcccgcgaagaacggaaccgtgatggacgttatttcccgcagagatcaacggggctctgggcaggtgggaacatacggcctgaacaccttcacgaatatggaagtccagctcatcagacagatggagagcgaagggatttttctgccgtccgagcttgagacccctaacctggccgaacgcgtgctcgactggctggagaagcatggagctgaacggcttaaaagaatggccatctctggcgacgattgtgtggttaagcccattgacgatcgcttcgctacagccctgaccgcgctcaatgacatggggaaagtgcggaaggatacacctcaatgggagcccagcaaaggctggaacgactggcagcaggtccctttttgctcccaccacttccatcagctgatcatgaaggatggaagagaaatcgtggttccctgtcgcaatcaagacgagctggtgggccgggccagagtcagccagggggctggatggtctctccgcgagaccgcctgcctgggcaagtcctatgctcagatgtggcaacttatgtactttcaccggagagatctgcgcctcgccgctaacgccatttgtagcgcggtgccggtcgactgggtgcctacatctcggaccacgtggtccatccatgcccaccaccagtggatgacaaccgaagatatgctgagcgtttggaatagagtgtggattgaggaaaacccctggatggaggacaaaacccatgtctcctcttgggaagaggtgccctatcttgggaagcgggaggaccagtggtgcggaagcctgatcggcctcacagctagagccacctgggccacaaatattcaggttgctatcaaccaagtgcgccggctgattgggaatgaaaactacctggattacatgacgtccatgaaaagattcaagaatgagagcgaccctgaaggcgccctctggtga

SEQ ID NO: 18510 - RNA, 9879 nt, synthetic construct
  misc_feature 1..9879: note = derived and/or modified CDS sequence (opt5) from DENV-1__GQ868562__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagcacgaaaacctgaaatactctgtgatcgtcacggtgcataccggcgatcagcaccaagttgggaatgagacaaccgaacatggaacaatcgctaccattacgccccaggcccctacctccgagatccagctgacagactatggcgccctcaccctggactgtagcccccggacaggccttgatttcaacgaaatggtgctgctcaccatgaaggagaaatcttggctggtccacaagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcataccgccctgacaggggccacggaaattcagaccagcggaacaaccacaatctttgctggccaccttaaatgcagactgaagatggacaaactcaccctgaaggggatgtcctacgtgatgtgtacgggcagcttcaaactggagaaggaagtcgccgagacacagcatggaaccgtgcttgttcaggtgaagtatgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctacatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccaccaggtgttcgggaccgcctatggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcatacatggaccgaacaatacaagtttcaggctgatagccctaaacggctctccgccgcgattggcaaggcctgggaggagggggtgtgcggcatcagatctgctacgcgcctggaaaatattatgtggaaacagatcagcaacgagcttaatcacatcctgctcgaaaacgacatgaagttcacagtcgtggtgggagacgccaatggcattctggctcaggggaaaaagatgatccggccgcaacccatggagcacaaatattcctggaagtcttggggaaaggccaaaattatcggcgccgatattcagaacaccacctttatcatcgacgggcctgatacacccgaatgtcctgacggacagagagcttggaatatttgggaggtcgaggattacggcttcggcatctttaccacgaacatttggctgaagcttcgcgacagctatacacagatgtgcgatcatcggctcatgtccgcggccatcaaagacagcaaggctgttcacgccgatatggggtactggattgaatctgagaaaaatgaaacctggaagctggccagagcttccttcatcgaggtgaagacatgtacctggcccaaaagccatacactgtggtctaacggagtgctcgaatccgagatgatcattccgaagatctatggcgggcctattagccaacacaattaccgccccggatatttcacccagacggccggcccttggcacctggggaaacttgagctggactttgatctctgcgaaggaaccacagtcgtggttgacgagcattgcggcaaccggggcccctctctgagaaccacaaccgtgacggggaagatcattcacgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacacatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcacacaatgtggcatgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctatggaaacggcgttgtgacaacgagcgggacctacgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatatgtgtacatggggcagcctctgaataacgatgaagaccacgcgcactggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacatctgacactcagagcccagaacgctcttgataatctggtgatgctgcacaactccgaacagggaggcaaggcctaccggcatgcgatggaggaactccccgacaccattgagaccctgatgcttctggccctcatcgctgtcctgacaggcggggccaccctgtttttcctctctggaaagggccttgggaaaacaagcatcggactgctgtgtgttacggcttcctctgccctcctgtggatggccagcgtggagccgcactggattgctgcgtccatcattcttgaatttttcctgatggtgctcctgatccctgagcccgatcgccagagaacccctcaagacaatcagctggcctatgtcgtgattggcctcctttttatgatcctgacagttgctgccaacgaaatggggctgctcgagaccacaaagaaagatctgggaatcggctacgtggccgctgagaaccaccagcatgccaccatgcttgacgtcgatctgcggcccgcgagcgcctggacgctctatgctgtggccaccacagtcattacccctatgatgcgccacacaatcgaaaataccacggctaacatttctctgacagccatcgcgaatcaagccgctattctgatgggcctcgacaaggggtggcccatctccaaaatggatattggagtgccgcttctggccctgggctgctacagccaggttaaccctctcaccctgacagctgccgtgcttatgctggtcgctcattacgccatcatcgggcccggactccaggcgaaggccaccagagaggctcagaagcggaccgccgctggcattatgaaaaatcccacagtggacgggatcgttgccattgatctggaccctgtggtctatgacgccaagttcgaaaaacaactgggacagatcatgctccttattctgtgtacgtctcagatcctgctcatgcgcaccacatgggcgctgtgcgagtccatcacccttgctacaggcccgctgaccacgctctgggaaggcagccccgggaagttttggaacacaaccattgccgtgtctatggctaatatcttcagaggaagctacctggccggcgccgggctggctttctccctcatgaaatctcttggaggcgggcggcgcggaaccggcgcccagggcgagacactgggggagaagtggaagagacaactgaaccagctcagcaaatccgaatttaatacctataagcggagcggaattatggaggtggatagatccgaagcgaaagagggcctgaagcgcggggaaacaacgaaacacgccgtttctcggggaaccgctaagcttagatggttcgtcgagcgcaacctggtgaagcctgagggcaaagtgatcgacctcgggtgtggacggggcggctggagctactattgcgccgggctgaagaaagtcacagaagttaagggatacaccaaaggcgggcccggacatgaggaacctattcccatggctacatatggctggaatctggtgaagctccactccgggaaagatgtgtttttcatgcctccggagaagtgtgacacccttctgtgcgatatcggagaatctagccccaaccctacgatcgaggagggcagaaccctgcgcgtcctcaagatggtggaaccctggctgaaaggcaatcagttttgtattaagatccttaacccttacatgccctccgttgtggagacactggaacagatgcaacggaaacacgggggaatgctcgtcagaaatccgctgtctcgcaacagcacccatgagatgtactgggtgtcctgcggcacagggaatattgttagcgccgtgaacatgacctctcggatgctgctcaacagattcacaatggcgcaccgcaagcctacctatgagcgggacgtcgatctgggagccggcacgagacatgtggctgtggaacccgaggtcgccaatcttgacatcattgggcagcgcatcgaaaacattaaaaatgagcacaagtccacatggcactacgatgaagacaacccctataagacctgggcttaccatggaagctatgaggttaaaccttctggctccgccagctctatggtgaatggcgtggtcagactgctcaccaagccctgggatgtgatccctatggttacacagatcgctatgacggacaccacaccgtttgggcaacagcgggtgttcaaagagaaggtcgacacccgcacacccagagccaaacggggaaccacacagattatggaagtgaccgcgaagtggctgtggggctttctttccagaaacaagaaacctcggatctgtacgcgcgaggaattcaccagaaaggttcggagcaatgccgctattggggccgtgtttgtcgatgagaaccagtggaattccgctaaagaagccgtggaggacgagcgcttctgggatctggttcacagagaacgggagctccataagcaaggaaaatgcgccacatgcgtgtacaacatgatgggcaagcgcgaaaagaaactgggggagtttggcaaggcgaaaggaagcagagctatctggtatatgtggctgggcgcccggttcctcgaattcgaggccctggggtttatgaatgaggaccactggttctctcgcgaaaacagcctttccggagtcgagggcgaagggctgcataagctcggatacattctgagagatatctctaaaatccccggcgggaatatgtacgctgacgataccgccggctgggacacacggattaccgaggatgaccttcagaacgaggctaagatcacggatattatggaacctgagcacgccctgctcgcgacaagcatctttaaactgacctatcagaataaggtggtccgcgtgcagagacccgccaagaacggaacagttatggacgtgatttcccggcgcgatcaaagaggctctgggcaggtcggaacctacggcctgaacacgttcaccaatatggaagtgcagctcatccggcagatggagagcgaagggatctttctgccgtccgagcttgagacacctaacctggctgaaagagtgctcgactggctggagaaacacggagccgaacgccttaagcggatggctatttctggcgacgattgtgttgtgaaacccatcgacgatagattcgccaccgcgctgacagccctcaatgacatggggaaggtccgcaaagatattcctcaatgggagcccagcaagggctggaacgactggcagcaggtgcctttttgctcccatcacttccatcagctgatcatgaaggatggacgggaaattgttgtgccctgtagaaatcaagacgagctggtcggccgcgctcgggtgagccagggggccggatggtctctcagagagaccgcttgcctgggcaaatcctatgcccagatgtggcaacttatgtactttcaccgccgggatctgagactcgctgccaacgcgatctgtagcgccgtcccggtggactgggttcctacatctcgcaccacgtggtccatccacgctcatcaccagtggatgacaaccgaagatatgctgagcgtgtggaatcgggtctggattgaggaaaacccctggatggaggacaagacccatgtgtcctcttgggaagaggttccctatcttgggaaaagagaggaccagtggtgcggaagcctgatcggcctcacagcccgggccacctgggctacaaatattcaggtggccatcaaccaagtcagacgcctgattgggaatgaaaactacctggattatatgacgtccatgaagcggttcaaaaatgagagcgaccctgaaggcgcgctctggtga

SEQ ID NO: 18511 - RNA, 9879 nt, synthetic construct
  misc_feature 1..9879: note = derived and/or modified CDS sequence (opt5) from DENV-1__GQ868563__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacgctacctttatcatcgacgggcctgatacccccgaatgtcctgacggacagagagcgtggaatatttgggaggtcgaggattatggcttcggcatctttacaaccaacatttggctgaagcttcgcgacagctacacgcagatgtgcgatcaccggctcatgtccgccgctatcaaagacagcaaggccgttcatgccgatatggggtattggattgaatctgagaaaaatgaaacatggaagctggctagagcctccttcatcgaggtgaagacctgtacatggcccaaaagccacaccctgtggtctaacggagtgctcgaatccgagatgatcattccgaagatctacggcgggcctattagccaacataattatcgccccggatacttcacacagaccgcgggcccttggcacctggggaaacttgagctggactttgatctctgcgaaggaacgaccgtcgtggttgacgagcactgcggcaaccggggcccctctctgagaacaaccacagtgaccgggaagatcattcatgaatggtgttgccggagctgtacgctgcctccccttcgcttcagaggagaggatggctgctggtacgggatggagatccggccggtcaaagaaaaggaggaaaatctcgtgagatccatggttagcgctggatctggcgaggtggactcctttagcctggggatcctgtgtgtctccattatgatcgaagaggtgatgcgctctcggtggagcagaaagatgctcatgacaggaaccctggccgttttccttctgctcattatgggccagctgacatggaacgacctgacccgcctttgcatcatggtgggcgccaatgcttccgatagaatggggatgggaaccacatatctggccctcatggcgacgtttaaaatgcggcctatgttcgctgtcggcctgctctttcgcagactgacctctcgggaggtgcttctgctcacaattgggctgagcctggtggcctccgtcgaacttcccaactctctggaggaactcggagacggcctggccatggggatcatgatgctcaagctgcttaccgagttccaaccccaccagctgtggacaaccctcctgagcctgacgtttgttaaaacaaccctttccctggattacgcttggaagaccacagccatggtgctcagcattgtgtctctgttccctctctgtctgtccaccacaagccagaaaacgacctggcttccggtcctgctgggatcttttggctgcaagcccctcacaatgttcctgatcaccgaaaacaagatctggggccgcaaatcctggcctcttaatgaggggattatggctatcggaattgtgagcatcctgctctcttccctgctcaagaacgacgttcccctggccggccctcttattgcggggggaatgctgatcgcctgttatgtgatcagcggctccagcgctgatctgtctctcgagaaagccgctgaagtcagctgggagcaggaagccgagcattccggggcctctcacaatattctggtggaagttcaagacgatggaacaatgaagatcaaagacgaggagagagatgacacccttacgattctgctcaaggctaccctgctcgcggtgagcggcgtctaccccatgtccatccctgccacactgtttgtgtggtatttctggcagaaaaagaagcagcggtctggcgtcctttgggatacccccagcccgcctgaagtggagcgcgctgttctggacgatgggatttacagaatcctgcagcggggactcctgggccgctcccaagtgggggtcggagtgttccaggacggcgtttttcatacaatgtggcacgtgaccagaggggccgtccttatgtatcagggaaaacggctggaaccctcttgggccagcgtgaagaaagacctcatctcctacggcggcgggtggagattccagggactgtggaacacaggcgaggaggtgcaagttattgctgtcgaacctgggaagaatcccaaaaacgtgcagacgaccccgggaacatttaagacccctgagggcgaagtgggggccatcgcgctcgatttcaagcccggaaccagcggctctcctattgtcaatcgcgagggcaaaatcgtggggctgtacggaaacggcgttgtgacaacgtccgggacctatgtcagcgctattgcccaggccaaggcttctcaagaaggaccccttcccgagatcgaggacgaagtgtttaaaaagcggaatctgacaattatggatctgcaccctggctccgggaaaaccagacgctacctcccggccatcgttcgggaggcgatcaagagaaagctgcgcacacttattctggctcccacccgggtggtcgccagcgaaatggccgaggctctcaaaggcatgcctatcagatatcagacgacagccgtgaagtccgaacataccggacgcgagattgttgacctgatgtgccacgctaccttcacaatgcggctgctctctcccgtgagagtccctaactacaatatgatcattatggatgaggcccattttaccgaccccgcgagcatcgccgctcggggctatatctccacacgcgtggggatgggagaagccgctgccattttcatgaccgccacgcctccgggcagcgtggaggcttttccccagtctaacgcggtcatccaggatgaagagagagacattcctgaacggtcctggaatagcgggtacgattggatcacagacttccccggaaaaaccgtttggtttgtgccttctattaagagcggcaacgatatcgccaattgtcttcgcaaaaacgggaagagagtgatccaactgtcccggaagacattcgacaccgagtatcagaaaacgaagaacaatgactgggattacgtcgtgaccacagacatttctgagatgggcgctaacttcagagccgatcgcgttatcgacccccggagatgcctgaaaccggtgattctcaaggatggacctgaacgcgtcatcctggccggccccatgcccgtgaccgttgctagcgccgcgcagcggagagggcgcattggacggaatcagaacaaagagggcgaccaatacgtgtatatggggcagcctcttaataacgatgaagaccacgctcattggacagaggccaagatgctgctcgataatatcaacacccccgagggaattatccctgccctgtttgaaccggagagagaaaagtccgctgccatcgacggcgagtaccgcctgagaggggaagcgcggaaaacattcgtcgagctcatgcgcagaggcgatcttcccgtgtggctgtcttataaggtcgccagcgagggatttcagtactccgaccggcgctggtgcttcgatggcgaaagaaataaccaggtgctggaggaaaatatggacgttgagatttggaccaaagaaggggagcggaagaaactcagacctcgctggctggacgctcggacgtatagcgatccccttgccctgagagagtttaaggaattcgctgccggacgccggtctgtgtccggcgacctcatcctggagattgggaaactgcctcaacacctcacacttagagctcagaacgccctggataatctggtgatgctccacaacagcgaacagggaggcaaggcgtaccggcatgccatggaggaactgcccgacaccatcgagacccttatgctgctcgctctgattgccgtcctgacaggcggggttaccctctttttcctttccggaaagggcctggggaaaacatctatcggactgctctgtgtgacggctagctccgccctgctttggatggcctctgtggagccgcactggatcgctgcgagcattatcctggaatttttcctcatggtcctgctgattcctgagcccgatcgccagagaacccctcaagacaatcagctcgcctatgtggttatcggccttctgtttatgattctgacagtggctgccaacgaaatggggctcctggagaccacaaagaaagatcttggaatcggctacgccgctgccgagaaccatcagcacgcgaccatgctggacgtcgatctccggcccgcctccgcttggacgctgtacgccgtggctaccacagtcatcacccctatgatgcgccacacaattgaaaataccacggccaacatcagcctgacagcgattgccaatcaagctgccatcctcatgggccttgacaaggggtggcccatttctaaaatggatatcggagtgccgctgctggctctcggctgctattcccaggttaaccctctgacccttacagccgctgtgctgatgctcgtcgcccattacgcgattatcgggcccggactgcaggccaaggctaccagagaggcccagaagcggaccgctgccggcatcatgaaaaatcccacagtggacgggattgttgccatcgatctggaccctgtggtctatgacgcgaagttcgaaaaacaactcggacagattatgcttctgatcctgtgtacgagccagattctcctgatgcgcaccacatgggctctttgcgagtctatcaccctggccacaggcccgctcaccacgctgtgggaaggctcccccgggaagttttggaacacaaccatcgctgtgagcatggccaatattttcagaggatcttacctggccggcgctgggctcgccttcagccttatgaaatccctgggaggcgggcggcgcggaaccggcgcgcagggcgagacactgggggagaagtggaagagacaactcaaccagctgtctaaaagcgaatttaatacctataagcggtccggaatcatggaggtggatagaagcgaagccaaagagggccttaagcgcggggaaacaacgaaacacgctgtttcccggggaaccgccaagctgagatggttcgtcgagcgcaacctcgtgaagcctgagggcaaagtgattgacctggggtgtggacggggcggctggtcttactattgcgctgggctgaagaaagtcacagaagttaagggatacaccaaaggcgggcccggacatgaggaacctatccccatggccacatacggctggaatctcgtgaagcttcacagcgggaaagatgtgtttttcatgcctccggagaagtgtgacaccctgctgtgcgatattggagaatcctctcccaaccctacgatcgaggagggcagaaccctccgcgtcctgaagatggtggaaccctggcttcggggcaatcagttttgtatcaaaattctgaacccttatatgcccagcgttgtggagacactcgaacagatgcaaagaaagcatgggggaatgctggtccgcaatccgctgtcccggaactctacccacgagatgtactgggtgagctgcggcacagggaatatcgtttccgcggtgaacatgaccagcagaatgctcctgaaccgcttcacaatggcccaccggaaacctacctatgagagagacgtcgatcttggagctggcacgcgccatgtggccgtggaacccgaggtccccaatctggacattatcgggcagagaattgaaaacatcaagaatgagcacaaatctacatggcattacgatgaagacaacccttataagacctgggcttaccacggatcctatgaggttaagcccagcggctctgcctccagcatggtgaatggcgtggtccggctcctgaccaaaccttgggatgtgattccgatggttacacagatcgctatgacggacaccacaccctttgggcaacagcgcgtgttcaaggagaaagtcgacaccagaacacctcgggccaagagaggaaccacacagatcatggaagtgaccgcgaaatggctttggggctttctgtctcggaacaagaagccccgcatttgtacgagagaggaattcacccggaaagttcgctccaatgccgctatcggggccgtgtttgtcgatgagaaccagtggaatagcgctaaggaagccgtggaggacgagagattctgggatctcgttcaccgggaacgcgagctgcataaacaaggaaagtgcgccacatgcgtgtacaacatgatgggcaaaagagaaaagaagctgggggagtttggcaaagcgaagggatcccgggctatttggtacatgtggctcggcgcccgcttcctggaattcgaggcccttgggtttatgaatgaggaccactggttcagcagagaaaactctctgagcggagtcgagggcgaagggctccataaactgggatatatccttcgggatatttccaagatccctggcgggaatatgtacgctgacgataccgccggctgggacacacgcatcaccgaggatgacctgcagaacgaggctaaaattacggatatcatggaacccgagcacgccctcctggcgacatctatttttaagctgacctatcagaataaagtggtcagagtgcagcggccggccaagaacggaacagttatggacgtgatcagccgcagagatcaacggggctccgggcaggtcggaacctacggcctcaacacgttcaccaatatggaagtgcagctgattagacagatggagtctgaagggatctttcttcctagcgagctggagacacccaacctcgctgaacgcgtgctggactggcttgagaagcatggagccgaacggctgaaaagaatggctatctccggcgacgattgtgttgtgaagcctattgacgatcgcttcgccaccgcgctcacagccctgaatgacatggggaaagtccggaaggatatcccccaatgggagccttctaaaggctggaacgactggcagcaggtgcccttttgcagccaccacttccatcagctgattatgaaggatggaagagaaatcgttgtgccgtgtcgcaatcaagacgagctcgtcggccgggctagagtgtcccagggggccggatggagcctgcgcgagaccgcttgccttggcaagtcttatgcccagatgtggcaactgatgtactttcaccggagagatctccgcctggctgccaacgcgatttgttccgccgtccctgtggaatgggttcccacaagccggaccacgtggtctatccatgctcaccaccagtggatgacaaccgaggacatgctttccgtgtggaatagagtctggatcgaagagaacccctggatggaagataaaacccatgtgagctcctgggaggaggttccttatctggggaagcgggaagaccagtggtgcggatctctcattggcctgacagccagagccacctgggctacaaatatccaggtggccattaaccaagtccgccggctgatcgggaatgagaactacctcgactacatgacgagcatgaaaagattcaagaatgaatccgatccggagggcgcgctgtggtga

SEQ ID NO: 18512 - RNA, 9879 nt, synthetic construct
  misc_feature 1..9879: note = derived and/or modified CDS sequence (opt5) from DENV-1__GQ868564__SS-prME
  source 1..9879: mol_type = other RNA
agcgtgacaatgctgcttatgctgcttcccacagccctggctttccacctgacgacccggggcggggaacctcatatgatcgtctccaagcaggaacggggaaaagccctgctttttaagacatctgcgggcgttaacatgtgcaccctgattgctatggacctcggggaactgtgtgaagatacaatgacctacaaatgcccccgcatcacagaggccgaacccgacgatgtggactgttggtgcaatgccaccgatacgtgggtgacctatggaacatgtagccaaaccggcgagcaccggcgggacaagcgctccgtcgctctggcccctcatgtggggctcggactggagacaagaaccgaaacgtggatgtctagcgagggcgcttggaaacagattcagcgggttgaaacatgggcccttcgccaccccggcttcaccgtgatcgcgctgtttctcgcccatgctattgggacatccatcacccagaagggaatcattttcatcctgcttatgctggtcaccccttctatggccatgagatgcgtgggcattgggaaccgggattttgttgagggactcagcggcgctacatgggtggacgtcgtgctggagcacgggtcctgtgtgacgaccatggccaagaataaacccacactggatatcgaactcctgaagaccgaggtcacaaaccctgcggttcttcgcaaactgtgcattgaagccaagatcagcaataccacgacagactctagatgtccgacccaaggagaggctaccctcgtggaagaacaggatgccaacttcgtgtgccggcgcacatttgtcgacagaggctggggcaatgggtgtggactgttcggcaaagggtcccttctgacctgcgctaagtttaagtgcgtgacaaaactcgagggaaagattgttcagtacgaaaacctgaaatatagcgtgatcgtcacggtgcacaccggcgatcagcatcaagttgggaatgagacaaccgaacacggaacaatcgccaccattacgccccaggcccctacctctgagatccagctgacagactacggcgctctcaccctggactgtagcccccggacaggccttgatttcaacgaaatggtgctgctcaccatgaaggagaaaagctggctggtccataagcagtggtttcttgacctgcctctcccctggacgtctggggcgtccacaagccaagagacctggaatcgccaggatctgctggtgacattcaaaaccgcccacgctaagaagcaggaagtcgtggttctcggatcccaagagggcgccatgcacaccgccctgacaggggctacggaaattcagacctctggaacaaccacaatctttgccggccatcttaaatgcagactgaagatggacaaactcaccctgaaggggatgagctatgtgatgtgtacgggctccttcaaactggagaaggaagtcgcggagacacagcacggaaccgtgcttgttcaggtgaagtacgagggcaccgatgctccgtgcaaaattcctttcagcacacaagacgaaaagggggtcacccagaacggacggctcatcacagccaatcccatcgtgacggataaagagaagcctgtgaacattgaaaccgagccgccctttggcgagtcttatatcgttgtcggggccggagaaaaagctctgaagctgtcctggttcaagaaaggcagctctattgggaagatgtttgaggccacagctagaggcgcccgccggatggcgatcctcggagacaccgcctgggatttcggcagcattgggggagtgtttacatccgtgggcaaactggtccatcaggtgttcgggaccgcttacggagttctcttttctggcgtgagctggacgatgaagatcgggatcggcattctgctcacctggctgggactcaattccagaagcacatctctttccatgacctgtatcgccgtcggcatggtgacactctacctgggggttatggtgcaggctgacagcggatgcgtcattaactggaaaggccgcgaactgaagtgtgggtctggaatcttcgtgaccaacgaggttcacacatggaccgaacaatataagtttcaggccgattcccctaaacggctcagcgcggccattggcaaggcttgggaggagggggtgtgcggcatcagatccgccacgcgcctggaaaatattatgtggaaacagatctctaacgagcttaatcatatcctgctcgaaaacgacatgaagttcacagtcgtggtgggagacgctaatggcattctggcccaggggaaaaagatgatccggccgcaacccatggagcacaaatacagctggaagtcctggggaaaggccaaaattatcggcgctgatattcagaacaccacctttatcatcgacgggcctgatacacccgaatgtcctgacggacagagagcgtggaatatttgggaggtcgaggattatggcttcggcatctttaccacgaacatttggctgaaacttcgcgactcttacacacagatgtgcgatcaccggctcatgagcgccgctatcaaagactccaaggccgttcatgccgatatggggtattggattgaaagcgagaaaaatgaaacctggaagctggctagagcctctttcatcgaggtgaagacatgtacctggcccaaatcccacacactgtggagcaacggagtgctcgaatctgagatgatcattccgaagatctacggcgggcctatttcccaacataattatcgccccggatacttcacccagacggcgggcccttggcacctggggaaacttgagctggactttgatctctgcgaaggaaccacagtcgtggttgacgagcactgcggcaaccggggccccagcctgagaaccacaaccgtgacggggaagatcattcatgaatggtgttgccggtcttgtacactgcctccccttcgcttcagaggagaggatggctgctggtacgggatggagatccggccggtcaaagaaagagaggaaaatctcgtgcgcagcatggtttccgctggaagcggcgaggtggactctttttccctggggatcctgtgtgtcagcattatgatcgaagaggtgatgcggtccagatggtctcgcaagatgctcatgaccggaacactggccgttttccttctgctcattatgggccagctgacctggaacgacctgaccagactttgcatcatggtgggcgccaatgctagcgatcggatggggatgggaacaacgtatctggccctcatggcgacctttaagatgcgccctatgttcgctgtcggcctgctctttagacggctgacatcccgcgaggtgcttctgctcaccattgggctgtctctggtggccagcgtcgaacttcccaactccctggaggaactcggagacggcctggccatggggatcatgatgctcaaactgcttacagagttccaaccccaccagctgtggaccacgctcctgtctctgacatttgttaagaccacccttagcctggattacgcttggaaaacaaccgccatggtgctctccattgtgagcctgttccctctctgtctgtctacaacgtcccagaagaccacatggcttccggtcctgctgggatcctttggctgcaaacccctcaccatgttcctgatcacagaaaacaagatctggggcagaaagtcttggcctcttaatgaggggattatggctatcggaattgtgtccatcctgctcagctctctgctcaaaaacgacgttcccctggccggccctcttattgccgggggaatgctgatcgcctgttatgtgatctccggcagctccgctgatctgagcctcgagaaggccgctgaagtctcttgggagcatgaagccgagcacagcggggcctcccataatattctggtggaagttcaggacgatggaaccatgaaaatcaaggacgaggagcgggatgacacgcttaccattctgctcaaagctgcgctgctcgccgtgtctggcgtctaccccatgagcatccctgctacactgtttgtgtggtatttctggcaaaagaaaaagcagcgctccggcgtcctttgggataccccctctccgcctgaagtggagagagccgttctggacgatgggatttaccggatcctgcagcgcggactcctgggcagaagccaggtgggggtcggagtgttccaagacggcgtttttcacacaatgtggcacgtgaccagaggggcggtccttatgtatcagggaaagcggctggaaccctcctgggcttctgtgaaaaaggacctcatcagctacggcggcgggtggcgcttccagggatcctggaacacaggcgaggaggtgcaggttattgccgtcgaacctgggaaaaatcccaagaacgtgcaaacgaccccgggaacatttaaaacccctgagggcgaagtgggggcgatcgctctggatttcaagcccggaaccagcggctctcctattgtcaatcgggagggcaagatcgtggggctctacggaaacggcgttgtgacaacgtccgggacctatgtcagcgccattgcccaggctaaagcctctcaggaaggacccctgcccgagatcgaggacgaagtgtttaagaaaagaaatcttacaattatggatctgcatcctggctccgggaagacccgccggtacctgccggcgatcgttagagaggctatcaaacgcaagctccggacactgattcttgcccccaccagagtggtcgccagcgaaatggctgaggccctgaagggcatgcctatccgctatcaaacgacagctgtgaaatccgaacacaccggacgggagattgttgacctcatgtgccatgccaccttcacaatgagactgctgtctcccgtgcgggtccctaactacaatatgatcattatggatgaggcgcactttaccgaccccgccagcatcgctgcccgcggctatatctccacaagagtggggatgggagaagctgccgccattttcatgaccgctacgcctccgggcagcgtggaggcgtttccccagtctaacgccgtcatccaggatgaagaacgggacattcctgaacgctcctggaatagcgggtacgattggatcacagacttccccggaaagaccgtttggtttgtgccttctattaaaagcggcaacgatatcgctaattgtctcagaaagaacgggaaacgggtgatccagctttccagaaagacattcgacaccgagtatcaaaagacgaaaaacaatgactgggattacgtcgtgaccacagacatttctgagatgggcgccaacttccgcgccgatcgggttatcgaccccagacgctgcctgaagccggtgattctgaaagatggacctgaacgggtcatcctcgctggccccatgcccgtgaccgttgccagcgcggctcagagacgcgggcggattggaagaaatcagaacaaggagggcgaccagtacgtgtatatggggcaacctctgaataacgatgaagaccatgcccactggacagaggccaaaatgcttctggataatatcaacacccccgagggaattatccctgctctctttgaaccggagcgcgaaaagtccgccgcgatcgacggcgagtacagactgagaggggaagcccgcaagacattcgtcgagctgatgagacggggcgatctccccgtgtggctttcttataaagtcgctagcgagggatttcagtactccgaccgcagatggtgcttcgatggcgaacggaataaccaggtgctggaggaaaatatggacgttgagatttggaccaaggaaggggagcgcaagaagctgcgccctcggtggctcgacgccagaacgtatagcgatcccctggctcttagagagtttaaagagttcgccgctggacggagatctgtgtccggcgacctgatcctcgagattgggaagctgcctcagcacctgacactccgggcccaaaacgcgcttgataatctggtgatgctgcataacagcgaacagggaggcaaagcctaccgccacgctatggaggaactccccgacaccatcgagaccctgatgcttctggccctcattgctgtcctgacaggcggggttaccctgtttttcctctccggaaagggccttgggaagacatctatcggactgctgtgtgtgacggccagctccgccctcctgtggatggcttctgtggagccgcattggatcgcggccagcattatccttgaatttttcctgatggtcctcctgattcctgagcccgatagacagcggacccctcaggacaatcaactggcttatgtggttatcggcctcctttttatgattctgacagtggccgccaacgaaatggggctgctcgagaccaccaaaaaggatctgggaatcggccacgtcgctgccgagaaccaccagcatgcgaccatgcttgacgtggatctgcgccccgcctccgcttggacgctctacgccgtcgctaccacagtgatcacccctatgatgagacacacaattgaaaataccacggccaacatcagcctgacagcgattgccaatcaggctgccatcctgatgggcctcgacaaagggtggcccatttctaagatggatatcggagttccgcttctggctctgggctgctactcccaagtgaaccctctcaccctgacagccgctgtccttatgctggtggcccattatgcgattatcgggcccggactccaggccaaagctacccgggaggcccagaagcgcaccgctgccggcatcatgaagaatcccacagttgacgggattgtggccatcgatctggaccctgtcgtgtacgacgcgaaattcgaaaagcagctgggacaaattatgctccttatcctgtgtacgagccagattctgctcatgagaaccacatgggctctgtgcgagtctatcacccttgccacaggcccgctgaccacgctctgggaaggctcccccgggaaattttggaacacaaccatcgctgtgagcatggccaatattttccggggatcttatctggccggcgctgggctggccttcagcctcatgaagtcccttggaggcgggcgcagaggaaccggcgcgcagggcgagacactgggggagaaatggaagcggcagctgaaccaactctctaagagcgaatttaatacctacaaaagatccggaatcatggaggttgatcgcagcgaagccaaggagggcctgaaaagaggggaaacaacgaagcacgctgtctccagaggaaccgccaaacttcgctggttcgtggagcggaacctggtgaagcctgagggcaaggtcattgacctcgggtgtggaagaggcggctggtcttattactgcgctgggctgaaaaaggttacagaagtgaaaggatataccaagggcgggcccggacatgaggaacctatccccatggccacatacggctggaatctggtgaaactccacagcgggaaggatgtctttttcatgcctccggagaaatgtgacacccttctgtgcgatattggagaatcctctcccaaccctacgatcgaggagggccgcaccctgcgggtgctcaagatggttgaaccctggctgagaggcaatcagttttgtatcaagattcttaacccttacatgcccagcgtggtcgagacactggaacagatgcagcgcaaacacgggggaatgctcgtgcggaatccgctgtccagaaactctacccatgagatgtattgggttagctgcggcacagggaatatcgtgtccgcggtcaacatgaccagccgcatgctgctcaaccggttcacaatggcccacagaaagcctacctacgagcgcgacgtggatctgggagctggcacgagacatgtggccgtcgaacccgaggttgctaatcttgacattatcgggcaacggattgaaaacatcaaaaatgagcacaagtctacatggcactatgatgaagacaacccctacaaaacctgggcctatcatggatcctacgaggtgaagcctagcggctctgcttccagcatggtgaatggcgtcgtgcgcctgctcaccaagccctgggatgttattcctatggtgacacagatcgccatgacggacaccacaccgtttgggcagcaaagagtcttcaaagagaaggtggacacccggacacccagagcgaaacggggaaccacacagatcatggaagttaccgccaagtggctgtggggctttctttctcgcaacaaaaagcctagaatttgtacgcgggaggagttcacccgcaaggtgagatccaatgctgccatcggggctgtctttgtggatgagaaccagtggaatagcgccaaagaagccgttgaggacgagcggttctgggatctggtgcaccgcgaaagagagctccataagcagggaaaatgcgcgacatgcgtctataacatgatgggcaagcgggagaaaaagctgggggagtttggcaaggctaaaggatcccgcgccatttggtacatgtggctgggcgccagattcctcgagttcgaggctctggggtttatgaatgaggaccactggttcagccgggaaaactctcttagcggagtggagggcgaagggctgcataagctcggatacatcctgcgcgatatttccaaaatccccggcgggaatatgtatgccgacgataccgctggctgggacacaagaatcaccgaggatgaccttcaaaacgaggccaagattacggatatcatggaacctgagcacgcgctgctcgccacatctatttttaaactgacctaccagaataaggtcgtgcgggttcagcgccccgctaaaaacggaacagtgatggacgtcatcagcagacgggatcagagaggctccgggcaagtgggaacctatggcctgaacacgttcaccaatatggaagtgcagctcattcgccagatggagtctgaagggatctttctgccgagcgagcttgagacacctaacctggccgaacgggttctcgactggctggagaagcacggagctgaaagacttaagcgcatggccatctccggcgacgattgtgtggtcaaacccattgacgatcggttcgcgaccgccctgacagctctcaatgacatggggaaggtgagaaaagatatccctcagtgggagccctctaagggctggaacgactggcaacaggttcctttttgcagccatcacttccatcagctgattatgaaagatggacgcgaaatcgtggtcccctgtcggaatcaggacgagctggtgggcagagcccgcgtctcccaaggggctggatggagcctccgggagaccgcctgcctgggcaagtcttacgctcagatgtggcagcttatgtattttcacagacgcgatctgcggctcgccgcgaacgccatttgttccgctgtgccggttgaatgggtgcctacaagcagaaccacgtggtctatccacgcccatcaccaatggatgacaaccgaggacatgctgtccgtctggaatcgggtgtggatcgaagagaacccctggatggaagataagacccatgttagctcctgggaggaggtgccctaccttgggaaaagagaagaccagtggtgcggatctctgattggcctcacagcccgcgctacctgggccacaaatatccaggtcgcgattaaccaggtgcggagactgatcgggaatgagaactatctggactacatgacgagcatgaagcgcttcaaaaatgaatccgatcctgagggcgctctctggtga

SEQ ID NO: 18513 - RNA, 9879 nt, synthetic construct
  misc_feature 1..9879: note = derived and/or modified CDS sequence (opt5) from DENV-1__GQ868565__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacgctacctttatcatcgacgggcctgatacccccgaatgtcctgacggacagagagcgtggaatatttgggaggtcgaggattatggcttcggcatctttacaaccaacatttggctgaagcttcgcgacagctacacgcagatgtgcgatcaccggctcatgtccgccgctatcaaagacagcaaggccgttcatgccgatatggggtattggattgaatctgagaaaaatgaaacatggaagctggctagagcctccttcatcgaggtgaagacctgtacatggcccaaaagccacaccctgtggtctaacggagtgctcgaatccgagatgatcattccgaagatctacggcgggcctattagccaacataattatcgccccggatacttcacacagaccgcgggcccttggcacctggggaaacttgagctggactttgatctctgcgaaggaacgaccgtcgtggttgacgagcactgcggcaaccggggcccctctctgagaacaaccacagtgaccgggaagatcattcatgaatggtgttgccggagctgtacgctgcctccccttcgcttcagaggagaggatggctgctggtacgggatggagatccggccggtcaaagaaaaggaggaaaatctcgtgagatccatggttagcgctggatctggcgaggtggactcctttagcctggggatcctgtgtgtctccattatgatcgaagaggtgatgcgctctcggtggagcagaaagatgctcatgacaggaaccctggccgttttccttctgctcattatgggccagctgacatggaacgacctgacccgcctttgcatcatggtgggcgccaatgcttccgatagaatggggatgggaaccacatatctggccctcatggcgacgtttaaaatgcggcctatgttcgctgtcggcctgctctttcgcagactgacctctcgggaggtgcttctgctcacaattgggctgagcctggtggcctccgtcgaacttcccaactctctggaggaactcggagacggcctggccatggggatcatgatgctcaagctgcttaccgagttccaaccccaccagctgtggacaaccctcctgagcctgacgtttgttaaaacaaccctttccctggattacgcttggaagaccacagccatggtgctcagcattgtgtctctgttccctctctgtctgtccaccacaagccagaaaacgacctggcttccggtcctgctgggatcttttggctgcaagcccctcacaatgttcctgatcaccgaaaacaagatctggggccgcaaatcctggcctcttaatgaggggattatggctatcggaattgtgagcatcctgctctcttccctgctcaagaacgacgttcccctggccggccctcttattgcggggggaatgctgatcgcctgttatgtgatcagcggctccagcgctgatctgtctctcgagaaagccgctgaagtcagctgggagcaggaagccgagcattccggggcctctcacaatattctggtggaagttcaagacgatggaacaatgaagatcaaagacgaggagagagatgacacccttacgattctgctcaaggctaccctgctcgcggtgagcggcgtctaccccatgtccatccctgccacactgtttgtgtggtatttctggcagaaaaagaagcagcggtctggcgtcctttgggatacccccagcccgcctgaagtggagcgcgctgttctggacgatgggatttacagaatcctgcagcggggactcctgggccgctcccaagtgggggtcggagtgttccaggacggcgtttttcatacaatgtggcacgtgaccagaggggccgtccttatgtatcagggaaaacggctggaaccctcttgggccagcgtgaagaaagacctcatctcctacggcggcgggtggagattccagggactgtggaacacaggcgaggaggtgcaagttattgctgtcgaacctgggaagaatcccaaaaacgtgcagacgaccccgggaacatttaagacccctgagggcgaagtgggggccatcgcgctcgatttcaagcccggaaccagcggctctcctattgtcaatcgcgagggcaaaatcgtggggctgtacggaaacggcgttgtgacaacgtccgggacctatgtcagcgctattgcccaggccaaggcttctcaagaaggaccccttcccgagatcgaggacgaagtgtttaaaaagcggaatctgacaattatggatctgcaccctggctccgggaaaaccagacgctacctcccggccatcgttcgggaggcgatcaagagaaagctgcgcacacttattctggctcccacccgggtggtcgccagcgaaatggccgaggctctcaaaggcatgcctatcagatatcagacgacagccgtgaagtccgaacataccggacgcgagattgttgacctgatgtgccacgctaccttcacaatgcggctgctctctcccgtgagagtccctaactacaatatgatcattatggatgaggcccattttaccgaccccgcgagcatcgccgctcggggctatatctccacacgcgtggggatgggagaagccgctgccattttcatgaccgccacgcctccgggcagcgtggaggcttttccccagtctaacgcggtcatccaggatgaagagagagacattcctgaacggtcctggaatagcgggtacgattggatcacagacttccccggaaaaaccgtttggtttgtgccttctattaagagcggcaacgatatcgccaattgtcttcgcaaaaacgggaagagagtgatccaactgtcccggaagacattcgacaccgagtatcagaaaacgaagaacaatgactgggattacgtcgtgaccacagacatttctgagatgggcgctaacttcagagccgatcgcgttatcgacccccggagatgcctgaaaccggtgattctcaaggatggacctgaacgcgtcatcctggccggccccatgcccgtgaccgttgctagcgccgcgcagcggagagggcgcattggacggaatcagaacaaagagggcgaccaatacgtgtatatggggcagcctcttaataacgatgaagaccacgctcattggacagaggccaagatgctgctcgataatatcaacacccccgagggaattatccctgccctgtttgaaccggagagagaaaagtccgctgccatcgacggcgagtaccgcctgagaggggaagcgcggaaaacattcgtcgagctcatgcgcagaggcgatcttcccgtgtggctgtcttataaggtcgccagcgagggatttcagtactccgaccggcgctggtgcttcgatggcgaaagaaataaccaggtgctggaggaaaatatggacgttgagatttggaccaaagaaggggagcggaagaaactcagacctcgctggctggacgctcggacgtatagcgatccccttgccctgagagagtttaaggaattcgctgccggacgccggtctgtgtccggcgacctcatcctggagattgggaaactgcctcaacacctcacacttagagctcagaacgccctggataatctggtgatgctccacaacagcgaacagggaggcaaggcgtaccggcatgccatggaggaactgcccgacaccatcgagacccttatgctgctcgctctgattgccgtcctgacaggcggggttaccctctttttcctttccggaaagggcctggggaaaacatctatcggactgctctgtgtgacggctagctccgccctgctttggatggcctctgtggagccgcactggatcgctgcgagcattatcctggaatttttcctcatggtcctgctgattcctgagcccgatcgccagagaacccctcaagacaatcagctcgcctatgtggttatcggccttctgtttatgattctgacagtggctgccaacgaaatggggctcctggagaccacaaagaaagatcttggaatcggctacgccgctgccgagaaccatcagcacgcgaccatgctggacgtcgatctccggcccgcctccgcttggacgctgtacgccgtggctaccacagtcatcacccctatgatgcgccacacaattgaaaataccacggccaacatcagcctgacagcgattgccaatcaagctgccatcctcatgggccttgacaaggggtggcccatttctaaaatggatatcggagtgccgctgctggctctcggctgctattcccaggttaaccctctgacccttacagccgctgtgctgatgctcgtcgcccattacgcgattatcgggcccggactgcaggccaaggctaccagagaggcccagaagcggaccgctgccggcatcatgaaaaatcccacagtggacgggattgttgccatcgatctggaccctgtggtctatgacgcgaagttcgaaaaacaactcggacagattatgcttctgatcctgtgtacgagccagattctcctgatgcgcaccacatgggctctttgcgagtctatcaccctggccacaggcccgctcaccacgctgtgggaaggctcccccgggaagttttggaacacaaccatcgctgtgagcatggccaatattttcagaggatcttacctggccggcgctgggctcgccttcagccttatgaaatccctgggaggcgggcggcgcggaaccggcgcgcagggcgagacactgggggagaagtggaagagacaactcaaccagctgtctaaaagcgaatttaatacctataagcggtccggaatcatggaggtggatagaagcgaagccaaagagggccttaagcgcggggaaacaacgaaacacgctgtttcccggggaaccgccaagctgagatggttcgtcgagcgcaacctcgtgaagcctgagggcaaagtgattgacctggggtgtggacggggcggctggtcttactattgcgctgggctgaagaaagtcacagaagttaagggatacaccaaaggcgggcccggacatgaggaacctatccccatggccacatacggctggaatctcgtgaagcttcacagcgggaaagatgtgtttttcatgcctccggagaagtgtgacaccctgctgtgcgatattggagaatcctctcccaaccctacgatcgaggagggcagaaccctccgcgtcctgaagatggtggaaccctggcttcggggcaatcagttttgtatcaaaattctgaacccttatatgcccagcgttgtggagacactcgaacagatgcaaagaaagcatgggggaatgctggtccgcaatccgctgtcccggaactctacccacgagatgtactgggtgagctgcggcacagggaatatcgtttccgcggtgaacatgaccagcagaatgctcctgaaccgcttcacaatggcccaccggaaacctacctatgagagagacgtcgatcttggagctggcacgcgccatgtggccgtggaacccgaggtcgctaatctggacattatcgggcagagaattgaaaacatcaagaatgagcacaaatctacatggcattacgatgaagacaacccctataagacctgggcctaccacggatcctatgaggttaagcctagcggctctgcttccagcatggtgaatggcgtggtccggctcctgaccaaaccctgggatgtgattcctatggttacacagatcgccatgacggacaccacaccgtttgggcaacagcgcgtgttcaaggagaaagtcgacaccagaacaccccgggcgaagagaggaaccacacagatcatggaagtgaccgccaaatggctttggggctttctgtctcggaacaagaagcctcgcatttgtacgagagaggaattcacccggaaagttcgctccaatgctgccatcggggctgtgtttgtcgatgagaaccagtggaatagcgccaaggaagccgtggaggacgagagattctgggatctcgttcaccgggaacgcgagctgcataaacaaggaaagtgcgcgacatgcgtgtacaacatgatgggcaaaagagaaaagaagctgggggagtttggcaaagctaagggatcccgggccatttggtacatgtggctcggcgcccgcttcctggaattcgaggctcttgggtttatgaatgaggaccactggttcagcagagaaaactctctgagcggagtcgagggcgaagggctccataaactgggatatatccttcgggatatttccaagatccccggcgggaatatgtacgccgacgataccgctggctgggacacacgcatcaccgaggatgacctgcagaacgaggccaaaattacggatatcatggaacctgagcacgcgctcctggccacatctatttttaagctgacctatcagaataaagtggtcagagtgcagcggcccgctaagaacggaacagttatggacgtgatcagccgcagagatcaacggggctccgggcaggtcggaacctacggcctcaacacgttcaccaatatggaagtgcagctgattagacagatggagtctgaagggatctttcttccgagcgagctggagacacctaacctcgccgaacgcgtgctggactggcttgagaagcatggagctgaacggctgaaaagaatggccatctccggcgacgattgtgttgtgaagcccattgacgatcgcttcgcgaccgccctcacagctctgaatgacatggggaaagtccggaaggatatccctcaatgggagccctctaaaggctggaacgactggcagcaggtgcctttttgcagccaccacttccatcagctgattatgaaggatggaagagaaatcgttgtgccctgtcgcaatcaagacgagctcgtcggccgggccagagtgtcccagggggctggatggagcctgcgcgagaccgcctgccttggcaagtcttatgctcagatgtggcaactgatgtactttcaccggagagatctccgcctggccgcgaacgccatttgttccgctgtcccggtggaatgggttcctacaagccggaccacgtggtctatccatgcccaccaccagtggatgacaaccgaggacatgctttccgtgtggaatagagtctggatcgaagagaacccctggatggaagataaaacccatgtgagctcctgggaggaggttccctatctggggaagcgggaagaccagtggtgcggatctctcattggcctgacagccagagctacctgggccacaaatatccaggtggcgattaaccaagtccgccggctgatcgggaatgagaactacctcgactacatgacgagcatgaaaagattcaagaatgaatccgatcctgagggcgctctgtggtga

SEQ ID NO: 18514 - RNA, 9879 nt, synthetic construct
  misc_feature 1..9879: note = derived and/or modified CDS sequence (opt5) from DENV-1__GQ868568__SS-prME
  source 1..9879: mol_type = other RNA
agcgtgaccatgctgctcatgctgcttcccaccgctctggctttccacctcacgaccagaggcggggaacctcatatgatcgtctccaagcaggaacggggaaagtctctgctttttaagacaagcgccggcgttaatatgtgcaccctgattgcgatggacctcggggaactgtgtgaagatacaatgacctacaagtgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggcccttcgccaccccggcttcaccgtgatcgccctgtttctcgcgcatgtcattgggacatctatcacccagaagggaatcattttcatcctgcttatgctggtgacccctagcatggccatgagatgcgttggcattgggaatcgggattttgtggagggactctccggcgctacatgggtcgacgtggtgctggagcacgggagctgtgtcacgaccatggccaagaataaacccacactggatatcgaactcctgaagaccgaggttacaaaccctgctgtgcttcgcaaactgtgcattgaagccaagatctctaataccacgacagactccagatgtccgacccaaggagaggcgaccctcgtggaagaacaggatgccaacttcgtctgccggcgcacatttgtggacagaggctggggcaatgggtgtggactgttcggcaaagggagccttctgacctgcgctaagtttaagtgcgttacaaaactcgagggaaagattgtgcagtacgaaaacctgaaatattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggccagcacatcccaagagacctggaatcgccaggatctgctggtcacattcaaaaccgctcacgcgaagaagcaggaagtggttgtgctcggatctcaagagggcgccatgcacaccgctctgacaggggccacggaaattcagaccagcggaacaaccacaatctttgccggccatcttaaatgcagactgaagatggacaaactcaccctgaaggggatgtcctatgtcatgtgtacgggcagcttcaaactggagaaggaagtggctgagacacagcacggaaccgttcttgtgcaggtcaagtacgagggcaccgatgccccgtgcaaaattcctttctctacacaagacgaaaagggggtgacccagaacggacggctcatcacagcgaatcccatcgtgacggataaagagaagcctgttaacattgaaaccgagccgccctttggcgagtcctatatcgtcgtgggggctggagaaaaagccctgaagctgagctggttcaagaaaggctctagcattgggaagatgtttgaggccacagctagaggcgcccgccggatggctatcctcggagacaccgcctgggatttcggctccattgggggagtgtttacatctgtcggcaaactggtgcatcaggttttcgggaccgcgtacggagtgctttttagcggcgtctcctggatcatgaagatcgggattggcatcctgctcacgtggctgggactgaatagcagatctacctcccttagcatgacatgtattgccgtgggcatggttaccctctacctgggggtgatggtccaggctgactctggatgcgtgatcaactggaaaggccgcgaactgaagtgtgggtccggaattttcgttacaaacgaggtgcacacctggacagaacaatataagtttcaggccgatagccctaaacggctctccgctgccatcggcaaggcgtgggaggagggggtctgcggcattagatctgccacccgcctggaaaatatcatgtggaaacagatcagcaacgagcttaatcatattctgctcgaaaacgacatgaagttcacggtggtggtcggagacgctaatggcatcctggcccaggggaaaaagatgattcggccgcaacccatggagcacaaatactcctggaagtcttggggaaaggctaaaatcattggcgccgatacacagaacaccacctttatcatcgacgggcctgatacacccgaatgtcctgacggacagagagcctggaatatttgggaggttgaggattatggcttcggcatctttaccacgaacatttggctgaaacttcgcgacagctacacacagatgtgcgatcaccggctcatgtccgctgcgatcaaagacagcaaggccgtgcatgctgatatggggtattggattgaatctgagaaaaatgaaacctggaagctggccagagcctccttcatcgaggtgaagacatgtacctggcccaaaagccacacactgtggtctaacggagtcctcgaatccgagatgatcattccgaagatctacggcgggcctattagccaacataattatcgccccggatacttcacccagacggctggcccttggcacctggggaaacttgagctggactttgatctctgcgaaggaaccacagtggttgtggacgagcactgcggcaaccggggcccctctctgagaaccacaaccgtcacggggaagatcattcatgaatggtgttgccggagctgtacactgcctccccttcgcttcagaggagaggatggctgctggtacgggatggagatccggccggtgaaagaaaaggaggaaaatctcgttagatccatggtgagcgccggatctggcgaggtcgactcctttagcctggggatcctgtgtgtgtccattatgatcgaagaggttatgcgctctcggtggagcagaaagatgctcatgaccggaacactggcggtgttccttctgctcattatgggccagctgacctggaacgacctgacccgcctttgcatcatggtcggcgctaatgcctccgatagaatggggatgggaacaacgtatctggccctcatggctacctttaaaatgcggcctatgttcgccgtgggcctgctctttcgcagactgacatctcgggaggtgcttctgctcaccattgggctgagcctggtcgcgtccgttgaacttcccaactctctggaggaactcggagacggcctggctatggggatcatgatgctcaagctgcttacagagttccaaccccaccagctgtggaccacgctcctgagcctgacatttgtgaaaaccaccctttccctggattacgcctggaagacaaccgccatggtgctcagcattgtctctctgttccctctctgtctgtccacaacgagccagaaaaccacatggcttccggtgctgctgggatcttttggctgcaagcccctcaccatgttcctgatcacagaaaacaagatctggggccgcaaatcctggcctcttaatgaggggattatggctatcggaattgttagcatcctgctctcttccctgctcaagaacgacgtgcccctggccggccctcttattgctgggggaatgctgatcgcctgttatgtcatcagcggctccagcgcggatctgtctctcgagaaagccgctgaagtgagctgggagcaggaagccgagcattccggggcttctcacaatattctggttgaagtgcaagacgatggaaccatgaagatcaaagacgaggagagagatgacacgcttaccattctgctcaaggccacactgctcgccgtcagcggcgtgtaccccatgtccatccctgctaccctgtttgtctggtatttctggcagaaaaagaagcagcggtctggcgtgctttgggatacacccagcccgcctgaagttgagcgcgcggtgctggacgatgggatttacagaatcctgcagcggggactcctgggccgctcccaagtcggggtgggagttttccaggacggcgtgtttcataccatgtggcacgtcacaagaggggccgtgcttatgtatcagggaaaacggctggaaccctcttgggctagcgtgaagaaagacctcatctcctacggcggcgggtggagattccagggaagctggaacacgggcgaggaggttcaagtcattgccgtggaacctgggaagaatcccaaaaacgtgcagaccacaccgggaacctttaagacccctgagggcgaagtcggggccatcgctctggatttcaagcccggaacatctggctcccctattgtgaatcgcgagggcaaaatcgttgggctctacggaaacggcgtggtcacgaccagcgggacatatgtgtctgccattgcgcaggctaaggcctcccaagaaggacccctgcccgagatcgaggacgaagtttttaaaaagcggaatcttaccattatggatctgcaccctggcagcgggaaaacaagacgctacctgccggccatcgtgcgggaggctatcaagagaaagctccgcaccctgattcttgcccccacgcgggtcgtggcgtccgaaatggctgaggccctgaaaggcatgcctatcagatatcagacaaccgccgttaagtctgaacataccggacgcgagattgtggacctcatgtgccacgctacattcaccatgcggctgctgagccccgtcagagtgcctaactacaatatgatcattatggatgaggcccattttacagaccccgcttccatcgccgcgcggggctatatcagcacccgcgtggggatgggagaagccgctgccattttcatgacggctacacctccgggctctgtcgaggcctttccccagtccaacgccgttatccaggatgaagagagagacattcctgaacggagctggaactctgggtacgattggatcaccgacttccccggaaaaacagtgtggtttgtgcctagcattaagtccggcaacgatatcgctaattgtctccgcaaaaacgggaagagagtcatccaactttctcggaagaccttcgacacggagtatcagaaaaccaagaacaatgactgggattacgtggttacaaccgacattagcgagatgggcgcgaacttcagagccgatcgcgtgatcgacccccggagatgcctgaaaccggtcattctgaaggatggacctgaacgcgtgatcctcgctggccccatgcccgttacagtggcctccgccgctcagcggagagggcgcattggacggaatcagaacaaagagggcgaccaatacgtctatatggggcagcctctgaataacgatgaagaccacgcccattggaccgaggcgaagatgcttctggataatatcaacacacccgagggaattatccctgctctctttgaaccggagagagaaaagtctgccgccgtggacggcgagtaccgcctgagaggggaagctcggaaaaccttcgtcgagctgatgcgcagaggcgatctccccgtgtggcttagctataaggttgcctccgagggatttcagtacagcgaccggcgctggtgcttcgatggcgaaagaaataaccaggtgctggaggaaaatatggacgtggagatctggacgaaagaaggggagcggaagaaactgagacctcgctggctcgacgcgcggacatattctgatcccctggcccttagagagtttaaggagttcgctgccggacgccggtccgtcagcggcgacctgattctcgagatcgggaaactgcctcaacacctgaccctcagagctcagaacgcccttgataatctggttatgctgcacaactccgaacagggaggcaaggcttaccggcatgccatggaggaactccccgacaccattgagacactgatgcttctggcgctcatcgccgtgctgaccggcggggtgacactgtttttcctctctggaaagggccttgggaaaacgagcattggactgctgtgtgtcaccgcttcctctgccctcctgtggatggctagcgtggagccgcactggatcgccgcctccatcattcttgaatttttcctgatggttctcctgatccctgagcccgatcgccagagaacacctcaagacaatcagctggcttatgtggtcattggcctcctttttatgatcctgaccgtggcggccaacgaaatggggctgctcgagacaaccaagaaagatctgggaattggctacgtcgctgccgagaaccatcagcacgccacgatgcttgacgtggatctgcggcccgctagcgcctggaccctctacgcggttgccacaaccgtgatcacacctatgatgcgccacaccatcgaaaatacgacagctaacatttctctgaccgccatcgctaatcaagccgcgattctgatgggcctcgacaaggggtggcccatctccaaaatggatattggagtcccgcttctggccctgggctgctatagccaggtgaaccctctcacactgaccgctgccgttcttatgctggtggctcattacgccatcattgggcccggactccaggctaaggccaccagagaggcgcagaagcggacagccgctggcatcatgaaaaatcccacggtcgacgggatcgtggccattgatctggaccctgtggtttatgacgctaagttcgaaaaacaactgggacagatcatgctccttattctgtgtacctctcagatcctgctcatgcgcacaacctgggccctgtgcgagtccattacacttgccaccggcccgctgacgacactctgggaaggcagccccgggaagttttggaacaccaccatcgcggtctctatggctaatatcttcagaggaagctacctggccggcgctgggctggccttctccctcatgaaatctcttggaggcgggcggcgcggaacaggcgcccagggcgagaccctgggggagaagtggaagagacaactgaaccagctcagcaaatccgaatttaatacatataagcggagcggaattatggaggtggatagatccgaagctaaagagggcctgaagcgcggggaaacgaccaaacacgccgtgtctcggggaacagcgaaacttagatggttcgtcgagcgcaacctggttaagcctgagggcaaagtgatcgacctcgggtgtggacggggcggctggagctactattgcgccgggctgaagaaagtgaccgaagtcaagggatacacaaaaggcgggcccggacatgaggaacctattcccatggctacctacggctggaatctggtgaagctccactccgggaaagatgtgtttttcatgcctccggagaagtgtgacacgcttctgtgcgatatcggagaatctagccccaaccctaccattgaggagggcagaacactgcgcgttctcaagatggtcgaaccctggctgcggggcaatcagttttgtatcaaaatccttaacccttatatgccctccgtggttgagaccctggaacagatgcaaagaaagcatgggggaatgctcgtgcgcaatccgctgtctcggaacagcacacacgagatgtactgggtctcctgcggcaccgggaatattgtgagcgccgtgaacatgacatctagaatgctgctcaaccgcttcaccatggctcaccggaaacctacgtatgagagagacgtcgatctgggagccggcacacgccatgttgcggtggaacccgaggtggccaatcttgacatcattgggcagagaatcgaaaacattaagaatgagcacaaatccacctggcattacgatgaagacaacccctataagacctgggcttaccacggaagctatgaggtcaagccttctggctccgccagctctatggtgaatggcgttgtgcggctgctcacaaaaccctgggatgtcatccctatggtgacgcagattgctatgaccgacacaaccccgtttgggcaacagcgcgttttcaaggagaaagtggacacaagaacaccccgggccaagagaggaacaacccagatcatggaagtcacggctaaatggctgtggggctttctttcccggaacaagaagcctcgcatctgtaccagagaggagttcacacggaaagtgcgcagcaatgccgcgattggggccgtttttgtggatgagaaccagtggaactccgctaaggaagccgtcgaggacgagagattctgggatctggtgcaccgggaacgcgagctccataaacaaggaaagtgcgctacctgcgtctacaacatgatgggcaaaagagaaaagaagctgggggagtttggcaaagccaagggaagccgggccatctggtacatgtggctgggcgcgcgcttcctcgagttcgaggctctggggtttatgaatgaggaccactggttctctagagaaaacagcctttccggagtggagggcgaagggctgcataaactcggatatattctgcgggatatctctaagattcccggcgggaatatgtacgccgacgatacagccggctgggacacccgcatcacggaggatgaccttcagaacgaggctaaaatcacagatattatggaacctgagcacgccctgctcgctaccagcatctttaagctgacatatcagaataaagttgtgagagtccagcggcccgccaagaacggaaccgtgatggacgtgatttcccgcagagatcaacggggctctgggcaggttggaacgtacggcctgaacaccttcacaaatatggaagtgcagctcatcagacagatggagagcgaagggatttttctgccgtccgagcttgagacccctaacctggcggaacgcgtcctcgactggctggagaagcatggagccgaacggcttaaaagaatggctatctctggcgacgattgtgtggttaagcccatcgacgatcgcttcgccacagctctgaccgccctcaatgacatggggaaagtgcggaaggatattcctcaatgggagcccagcaaaggctggaacgactggcagcaggtccctttttgctcccaccacttccatcagctgatcatgaaggatggaagagaaattgtggtcccctgtcgcaatcaagacgagctggtgggccgggcgagagttagccagggggccggatggtctctccgcgagacagcttgcctgggcaagtcctatgcccagatgtggcaacttatgtactttcaccggagagatctgcgcctcgctgccaacgctatctgtagcgccgtgccggtcgaatgggtgcctacctctcggacgacatggtccattcatgcgcaccaccagtggatgaccaccgaggacatgctgagcgtttggaatagagtgtggatcgaagagaacccctggatggaagataaaacacatgtctcctcttgggaggaggtgccctatcttgggaagcgggaagaccagtggtgcggaagcctgatcggcctcaccgccagagctacatgggccacgaatattcaggtggccatcaaccaagttcgccggctgattgggaatgagaactacctggactacatgacctccatgaaaagattcaagaatgaaagcgatcctgagggcgctctctggtga

SEQ ID NO: 18515 - RNA, 9879 nt, synthetic construct
  misc_feature 1..9879: note = derived and/or modified CDS sequence (opt5) from DENV-1__GQ868569__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcgccaaccctgcggttcttcgcaaactgtgcattgaagccaagatctctaatacaaccacggactccagatgtccgacacaaggagaggctaccctcgtggaagagcaggatgccaacttcgtgtgccggcgcacctttgtcgacagaggctggggcaatgggtgtggactgttcggcaaagggagccttctgacatgcgctaagtttaagtgcgtgaccaaactcgagggaaagattgttcagtacgaaaacctgaaatattctgtgatcgtcacagtgcacacgggcgatcagcatcaagttgggaatgagaccacagaacacggaaccatcgccacaattaccccccaggcccctacgtccgagatccagctgaccgactacggcgctctcacactggactgtagcccccggaccggccttgatttcaacgaaatggtgctgctcacaatgaaggagaaatcttggctggtccataagcagtggtttcttgacctgcctctcccctggacctccggggcgagcacgtcccaagagacatggaatcgccaggatctgctggtgaccttcaaaacagcccacgctaagaagcaggaagtcgtggttctcggatctcaagagggcgccatgcacaccgccctgaccggggctacagaaattcagacgagcggaaccacaaccatctttgccggccatcttaaatgcagactgaagatggacaaactcacactgaaggggatgtcctatgtgatgtgtaccggcagcttcaaactggagaaggaagtcgcggagacgcagcacggaacagtgcttgttcaggtgaagtacgagggcaccgatgctccgtgcaaaattcctttctctacccaagacgaaaagggggtcacacagaacggacggctcatcaccgccaatcccatcgtgacagataaagagaagcctgtgaacattgaaacggagcccccctttggcgagtcctatatcgttgtcggggccggagaaaaagctctgaagctgagctggttcaagaaaggctctagcattgggaagatgtttgaggccaccgctagaggcgcccgccggatggcgatcctcggagacacagcctgggatttcggctccattgggggagtgtttacctctgtgggcaaactggtccatcaggtgttcgggacagcttacggagttctttttagcggcgtgtcctggaccatgaagatcgggatcggcattctgctcacgtggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatcttcgtgacaaacgaggttcacacctggacagaacaatataagtttcaggccgatagccctaaacggctctccgcggccattggcaaggcttgggaggagggggtgtgcggcatcagatctgccacccgcctggaaaatattatgtggaaacagatcagcaacgagcttaatcatatcctgctcgaaaacgacatgaagttcacggtcgtggtgggagacgctaatggcattctggcccaggggaaaaagatgatccggccgcaacccatggagcacaaatactcctggaagtcttggggaaaggccaaaattatcggcgctgatattcagaacgcgacatttatcatcgacgggcctgatacccccgaatgtcctgacggacagagagcctggaatatttgggaggtcgaggattatggcttcggcatctttaccacaaacatttggctgaagcttcgcgacagctacacccagatgtgcgatcaccggctcatgtccgctgccatcaaagacagcaaggccgttcatgctgatatggggtattggattgaatctgagaaaaatgaaacgtggaagctggccagagcgtccttcatcgaggtgaagacatgtacctggcccaaaagccacacactgtggtctaacggagtgctcgaatccgagatgatcattccgaagatctacggcgggcctattagccaacataattatcgccccggatacttcacccagacagctggcccttggcacctggggaaacttgagctggactttgatctctgcgaaggaaccacggtcgtggttgacgagcactgcggcaaccggggcccctctctgagaaccacaaccgtgacagggaagatcattcatgaatggtgttgccggagctgtaccctgcctccccttcgcttcagaggagaggatggctgctggtacgggatggagatccggccggtcaaagaaaaggaggaaaatctcgtgagatccatggttagcgccggatctggcgaggtggactcctttagcctggggatcctgtgtgtctccattatgatcgaagaggtgatgcgctctcggtggagcagaaagatgctcatgacgggaacactggccgttttccttctgctcattatgggccagctgacctggaacgacctgacacgcctttgcatcatggtgggcgctaatgcctccgatagaatggggatgggaaccacctatctggcgctcatggctacatttaaaatgcggcctatgttcgccgtcggcctgctctttcgcagactgacgtctcgggaggtgcttctgctcaccattgggctgagcctggtggcctccgtcgaacttcccaactctctggaggaactcggagacggcctggctatggggatcatgatgctcaagctgcttacagagttccaaccccaccagctgtggaccacactcctgagcctgacctttgttaaaacgacactttccctggattacgcctggaagaccaccgctatggtgctcagcattgtgtctctgttccctctctgtctgtccacaaccagccagaaaacaacgtggcttccggtcctgctgggatcttttggctgcaagcccctcaccatgttcctgatcacagaaaacaagatctggggccgcaaatcctggcctcttaatgaggggattatggccatcggaattgtgagcatcctgctctcttccctgctcaagaacgacgttcccctggcgggccctcttattgccgggggaatgctgatcgcttgttatgtgatcagcggctccagcgccgatctgtctctcgagaaagctgccgaagtcagctgggagcaggaagccgagcattccggggcttctcacaatattctggtggaagttcaagacgatggaaccatgaagatcaaagacgaggagagagatgacacacttaccattctgctcaaggcgacgctgctcgccgtgagcggcgtctaccccatgtccatccctgctaccctgtttgtgtggtatttctggcagaaaaagaagcagcggtctggcgtcctttgggatacacccagcccgcctgaagtggagcgcgccgttctggacgatgggatttacagaatcctgcagcggggactcctgggccgctcccaagtgggggtcggagtgttccaggacggcgtttttcataccatgtggcacgtgacaagaggggccgtccttatgtatcagggaaaacggctggaaccctcttgggctagcgtgaagaaagacctcatctcctacggcggcgggtggagattccagggactgtggaacatgggcgaggaggtgcaagttattgccgtcgaacctgggaagaatccccgcaacgtgcagaccacaccgggaacgtttaaaacccctgagggcgaagtgggggcgatcgctctcgatttcaagcccggaacaagcggctctcctattgtcaatcgggagggcaagatcgtggggctgtacggaaacggcgttgtgaccacctccgggacatatgtcagcgccattgcccaggctaaagcctctcaagaaggaccccttcccgagatcgaggacgaagtgtttaagaaaagaaatctgacgattatggatctgcaccctggctccgggaagacccgccggtacctcccggcgatcgttagagaggctatcaaacgcaagctgcggacacttattctggcccccaccagagtggtcgccagcgaaatggctgaggccctcaagggcatgcctatccgctatcagacaaccgctgtgaaatccgaacatacgggacgggagattgttgacctgatgtgccacgccacattcaccatgagactgctctctcccgtgcgggtccctaactacaatatgatcattatggatgaggcgcattttaccgaccccgccagcatcgctgcccgcggctatatctccacaagagtggggatgggagaagctgccgccattttcatgaccgctacacctccgggcagcgtggaggcgtttccccagtctaacgccgtcatccaggatgaagagcgggacattcctgaacgctcctggaatagcgggtacgattggatcaccgacttccccggaaagacggtttggtttgtgccttctattaaaagcggcaacgatatcgctaattgtcttagaaagaacgggaaacgggtgatccaactgtccagaaagacattcgacaccgagtatcagaagacaaaaaacaatgactgggattacgtcgtgaccacggacatttctgagatgggcgccaacttccgcgccgatcgggttatcgaccccagacgctgcctgaagccggtgattctcaaagatggacctgaacgggtcatcctggctggccccatgcccgtgaccgttgccagcgcggctcagagacgcgggcggattggaagaaatcagaacaaggagggcgaccaatacgtgtatatggggcagcctcttaataacgatgaagaccacgcccattggacagaggccaaaatgctgctcgataatatcaacacccccgagggaattatccctgctctgtttgaaccggagcgcgaaaagtccgccgcgatcgacggcgagtacagactgcggggggaagcccgcaagacattcgtcgagctcatgagacggggcgatcttcccgtgtggctgtcttataaagtcgctagcgagggatttcagtactccgaccgcagatggtgcttcgatggcgaacggaataaccaggtgctggaggaaaatatggacgttgagatttggaccaaggaaggggagagaaaaaagctccgccctcggtggctggacgccagaacatatagcgatccccttgctctgcgcgagtttaaagaattcgccgctggacggagatctgtgtccggcgacctcatcctggagattgggaagctgcctcaacacctcacccttcgggcccagaacgcgctggataatctggtgatgctccacaacagcgaacagggaggcaaagcctaccgccatgctatggaggaactgcccgacacgatcgagacacttatgctgctcgccctgattgctgtcctgaccggcggggttaccctctttttcctttccggaaagggcctggggaagacatctatcggactgctctgtgtgaccgccagctccgccctgctttggatggcttctgtggagccgcactggatcgcggccagcattatcctggaatttttcctcatggtcctgctgattcctgagcccgatagacagcggacacctcaagacaatcagctcgcttatgtggttatcggccttctgtttatgattctgacggtggccgccaacgaaatggggctcctggagaccacaaaaaaggatcttggaatcggctacgctgccgcggagaaccatcagcacgccaccatgctggacgtcgatctccgccccgcttccgcctggacactgtacgctgtggccaccacggtcatcacccctatgatgagacacacaattgaaaataccacagcgaacatcagcctgaccgccattgctaatcaagccgctatcctcatgggccttgacaaagggtggcccatttctaagatggatatcggagtgccgctgctggccctcggctgctattcccaggttaaccctctgacgcttacagctgccgtgctgatgctcgtcgcgcattacgccattatcgggcccggactgcaggctaaagccacccgggaggctcagaagcgcacagccgccggcatcatgaagaatcccaccgtggacgggattgttgcgatcgatctggaccctgtggtctatgacgctaaattcgaaaagcaactcggacagattatgcttctgatcctgtgtaccagccagattctcctgatgagaacaacgtgggccctttgcgagtctatcaccctggctacaggcccgctcaccacactgtgggaaggctcccccgggaaattttggaacaccacgatcgccgtgagcatggccaatattttccggggatcttacctggctggcgccgggctcgcgttcagccttatgaagtccctgggaggcgggcgcagaggaacaggcgcccagggcgagaccctgggggagaaatggaagcggcaactcaaccagctgtctaagagcgaatttaatacctataaaagatccggaatcatggaggtggatcgcagcgaagctaaggagggccttaaacggggggaaacaaccaagcacgccgtttccagaggaacagctaaactgcgctggttcgtcgagcggaacctcgtgaagcctgagggcaaggtgattgacctggggtgtggaagaggcggctggtcttactattgcgccgggctgaaaaaggtcacggaagttaaaggatacaccaagggcgggcccggacatgaggaacctatccccatggcgacatacggctggaatctcgtgaaacttcacagcgggaaggatgtgtttttcatgcctccggagaaatgtgacaccctgctgtgcgatattggagaatcctctcccaaccctacaatcgaggagggccgcaccctccgggtcctgaagatggtggaaccctggcttagaggcaatcagttttgtatcaagattctgaacccttatatgcccagcgttgtggagacgctcgaacagatgcaacgcaaacatgggggaatgctggtccggaatccgctgtccagaaactctacccacgagatgtactgggtgagctgcggcacagggaatatcgtttccgccgtgaacatgaccagccgcatgctcctgaaccggttcacaatggctcacagaaagcctacctatgagcgcgacgtcgatcttggagccggcacaagacatgtggctgtggaacccgaggtcgccaatctggacattatcgggcagcggattgaaaacatcaaaaatgagcacaagtctacctggcattacgatgaagacaacccctataaaacgtgggcttaccacggatcctatgaggttaagcctagcggctctgcctccagcatggtgaatggcgtggtccgcctcctgacaaagccctgggatgtgattcctatggttacccagatcgcgatgaccgacacaacgccgtttgggcaacagagagtgttcaaagagaaggtcgacacccggacacccagagccaaacggggaaccacacagatcatggaagtgaccgctaagtggctttggggctttctgtctcgcaacaaaaagcctagaatttgtacacgggaggaattcacccgcaaggttagatccaatgccgctatcggggccgtgtttgtcgatgagaaccagtggaatagcgccaaagaagcggtggaggacgagcggttctgggatctcgttcaccgcgaaagagagctgcataagcaaggaaaatgcgctacgtgcgtgtacaacatgatgggcaagcgggaaaaaaagctgggggagtttggcaaggccaaaggatcccgcgccatttggtacatgtggctcggcgctagattcctggaattcgaggcccttgggtttatgaatgaggaccactggttcagccgggaaaactctctgagcggagtcgagggcgaagggctccataagctgggatatatccttcgcgatatttccaaaatccccggcgggaatatgtacgctgacgataccgccggctgggacacaagaatcaccgaggatgacctgcagaacgaggcgaagattacagatatcatggaacctgagcacgccctcctggctacctctatttttaaactgacgtatcagaataaggtggtccgggtgcagcgccccgccaaaaacggaacagttatggacgtgatcagcagacgggatcaaagaggctccgggcaggtcggaacctacggcctcaacacattcaccaatatggaagtgcagctgattcgccagatggagtctgaagggatctttcttccgagcgagctggagacgcctaacctcgctgaacgggtgctggactggcttgagaagcatggagccgaaagactgaagcgcatggcgatctccggcgacgattgtgttgtgaaacccattgacgatcggttcgccaccgctctcacagccctgaatgacatggggaaggtcagaaaagatatccctcaatgggagccctctaagggctggaacgactggcagcaggtgcctttttgcagccaccacttccatcagctgattatgaaagatggacgcgaaatcgttgtgccctgtcggaatcaagacgagctcgtcggcagagctcgcgtgtcccagggggccggatggagcctgcgggagaccgcttgccttggcaagtcttatgcccagatgtggcaactgatgtactttcacagacgcgatctccggctggcggccaacgctatttgttccgccgtcccggtggaatgggttcctacaagcagaaccacatggtctatccatgcccaccaccagtggatgaccacggaggacatgctttccgtgtggaatcgggtctggatcgaagagaacccctggatggaagataagacacatgtgagctcctgggaggaggttccctatctggggaaaagagaagaccagtggtgcggatctctcattggcctgaccgctcgcgccacctgggcgacaaatatccaggtggctattaaccaagtccggagactgatcgggaatgagaactacctcgactacatgaccagcatgaagcgcttcaaaaatgaatccgatcctgagggcgccctgtggtga

SEQ ID NO: 18516 - RNA, 9879 nt, synthetic construct
  misc_feature 1..9879: note = derived and/or modified CDS sequence (opt5) from DENV-1__GQ868570__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaaggtcgggatcggcatcctgctcacctggctgggactgaatagcagatctacatcccttagcatgacctgtattgctgtgggcatggttacactctacctgggggtgatggtccaggccgacctgggatgcgtgatcaactggaaaggccgcgaactcaagtgtgggtctggaattttcgttaccaacgaggtgcacacatggaccgaacaatataagtttcaggctgattcccctaaacggctgagcgccgcgatcggcaaggcctgggaggagggggtctgcggcattagatccgtgacgcgccttgaaaatatcatgtggaaacagatttctaacgagctgaatcatatcctcctggaaaacgacatgaagttcacagtggtcgttggagacgctaatggcatcctggcccaggggaaaaagatgattcggccgcaacccatggagcacaaatacagctggaagtcctggggaaaggctaaaatcattggcgccgatacccagaacaccacatttatcattgacgggcctgatacccccgaatgtcctgacggacagagagcctggaatatctgggaggtggaggattatggcttcggcatctttacgacaaacatttggcttaagctccgcgactcttacacccagatgtgcgatcaccggctgatgagcgctgcgatcaaagactccaaggccgtgcatgctgatatggggtattggattgaaagcgagaaaaatgaaacatggaagctggccagagcctctttcatcgaggtcaagacctgtacatggcccaaatcccacaccctctggagcaacggagtgctggaatctgagatgattatcccgaagatctacggcgggcctatttcccaacataattatcgccccggatacttcacgcagaccgctggcccttggcaccttgggaaactggagctcgactttgatctgtgcgaaggaacaaccgttgtggtcgacgagcactgcggcaaccggggccccagcctgagaacaaccacggtgacagggaagatcattcatgaatggtgttgccggtcttgtacccttcctcccctccgcttcagaggagaggatggctgctggtacgggatggagatccggccggttaaagaaaaggaggaaaatctggtgagaagcatggtctccgccggaagcggcgaggtggactctttttccctggggattctctgtgttagcatcatgatcgaagaggtgatgcgctcccggtggtctagaaagatgctgatgacaggaacccttgcggtcttcctgctcctgattatgggccagctgacctggaacgaccttatccgcctgtgcattatggtgggcgctaatgccagcgatagaatggggatgggaacaacgtatctcgccctgatggctacctttaaaatgcggcctatgttcgccgtgggcctcctgtttcgcagacttacatcccgggaggtcctgctcctgaccatcgggctgtctcttgttgcgagcgtggaactgcccaactccctcgaggaactgggagacggcctcgctatggggattatgatgctgaagcttctgacagagttccaaccccaccagctctggaccacgctgctgtctcttacatttgtgaaaaccaccctgagcctcgattacgcctggaagacaaccgccatggtcctgtccatcgtgagcctcttccctctgtgtctttctacaacgtcccagaaaaccacatggctgccggttctgctcggaagctttggctgcaagcccctgaccatgttccttattacagaaaacaagatctggggccgcaaatcttggcctctgaatgaggggatcatggctattggaatcgtgtccattctcctgagctctctcctgaagaacgacgtcccccttgccggccctctgatcgctgggggaatgctgattgcctgttatgtgatctccggcagctccgcggatctcagcctggagaaagccgctgaagtttcttgggagcaggaagccgagcatagcggggcttcccacaatatccttgtggaagtccaagacgatggaaccatgaagattaaagacgaggagagagatgacacgctgaccatcctcctgaaggccacactcctggccgtgtctggcgtctaccccatgagcattcctgctaccctttttgtgtggtatttctggcagaaaaagaagcagcggtccggcgttctgtgggatacaccctctccgcctgaagtggagcgcgcggtcctggacgatgggatctacagaattctccagcggggactgcttggccgcagccaagtgggggttggagtgttccaggacggcgtctttcataccatgtggcacgtgacaagaggggccgtgctgatgtatcagggaaaacggctcgaaccctcctgggcttctgttaagaaagacctgatcagctacggcggcgggtggagattccagggatcctggaacacgggcgaggaggtccaagtgatcgccgtggaacctgggaagaatcccaaaaacgtccagaccacaccgggaacctttaagacccctgagggcgaagtgggggccattgctctcgatttcaagcccggaacaagcggctctcctatcgttaatcgcgagggcaaaattgtggggctgtacggaaacggcgtcgtgacgacctccgggacatatgttagcgccatcgcgcaggctaaggcctctcaagaaggaccccttcccgagattgaggacgaagtgtttaaaaagcggaatctgaccatcatggatctgcaccctggctccgggaaaacaagacgctacctcccggccattgtccgggaggctatcaagagaaagctgcgcacccttatcctggcccccacgcgggtggttgcgagcgaaatggctgaggccctcaaaggcatgcctattagatatcagacaaccgccgtgaagtccgaacataccggacgcgagatcgtcgacctgatgtgccacgctacattcaccatgcggctgctctctcccgtgagagtgcctaactacaatatgattatcatggatgaggcccattttacagaccccgctagcattgccgcgcggggctatatctccacccgcgtcgggatgggagaagccgctgccatcttcatgacggctacacctccgggcagcgttgaggcctttccccagtctaacgccgtgattcaggatgaagagagagacatccctgaacggtcctggaatagcgggtacgattggattaccgacttccccggaaaaacagtgtggtttgtcccttctatcaagagcggcaacgatattgctaattgtcttcgcaaaaacgggaagagagtgatccaactgtcccggaagaccttcgacacggagtatcagaaaaccaagaacaatgactgggattacgttgtgacaaccgacatctctgagatgggcgcgaacttcagagccgatcgcgtcattgacccccggagatgcctgaaaccggtgatcctcaaggatggacctgaacgcgttattctggctggccccatgcccgtgacagtcgccagcgccgctcagcggagagggcgcatcggacggaatcagaacaaagagggcgaccaatacgtgtatatggggcagcctcttaataacgatgaagaccacgcccattggaccgaggcgaagatgctgctcgataatattaacacacccgagggaatcattcctgctctgtttgaaccggagagagaaaagtccgccgccatcgacggcgagtaccgcctgagaggggaagctcggaaaaccttcgtcgagctcatgcgcagaggcgatcttcccgtgtggctgtcttataaggttgccagcgagggatttcagtactccgaccggcgctggtgcttcgatggcgaaagaaataaccaggtgctggaggaaaatatggacgtggagatctggacgaaagaaggggagcggaagaaactcagacctcgctggctggacgcgcggacatatagcgatccccttgccctgagagagtttaaggaattcgctgccggacgccggtctgtctccggcgacctcattctggagatcgggaaactgcctcaacacctcacccttagagctcagaacgccctggataatctggttatgctccacaacagcgaacagggaggcaaggcttaccggcatgccatggaggaactgcccgacaccattgagacacttatgctgctcgcgctgatcgccgtgctgaccggcggggtgacactctttttcctttccggaaagggcctggggaaaacgtctattggactgctctgtgtcaccgctagctccgccctgctttggatggcttctgtggagccgcactggatcgccgccagcatcattctggaatttttcctcatggttctgctgatccctgagcccgataagcagcgcacacctcaagacaatcagctcgcttatgtggtcattggccttctgtttatgatcctggcggtggccgctaacgaaatggggctcctggagaccacaaaaaaggatcttggaattggctacgtcgccaccgagaaccatcagcacgccacgatgctggacgtggatctcagacccgcttccgcctggaccctgtacgcggttgccacaaccgtgatcacacctatgatgcggcacaccatcgaaaatacgacagctaacattagcctgaccgccatcgctaatcaagccgcgattctcatgggccttgacaaagggtggcccatctctaagatggatattggagtcccgctgctggccctcggctgctattcccaggtgaaccctctgacacttaccgctgccgttctgatgctcgtggctcattacgccatcattgggcccggactgcaggctaaggccacccgcgaggcgcagaaaagaacagccgctggcatcatgaagaatcccacggtcgacgggatcgtggccattgatctggaccctgtggtttatgacgctaaattcgaaaagcaactcggacagatcatgcttctgattctgtgtaccagccagatcctcctgatgcggacaacctgggccctttgcgagtctattacactggccaccggcccgctcacgacactgtgggaaggctcccccgggaaattttggaacaccaccatcgcggtcagcatggctaatatcttccgcggatcttacctggccggcgctgggctcgccttcagccttatgaagtccctgggaggcgggagacggggaacaggcgcccagggcgagaccctgggggagaagtggaaacgccaactcaaccagctgtctaagagcgaatttaatatttataaaagatccggaatcatggaggtggatcggagcgaagctaaggagggccttaaaagaggggaaacaacgaagcacgccgtgtcccgcggaaccgcgaagctgcggtggttcgtcgagagaaacctcgttaaacctgagggcaaggtgattgacctggggtgtggacgcggcggctggtcttactattgcgccgggctgaaaaaggtgacagaagtcaaaggatacaccaagggcgggcccggacatgaggaacctatccccatggctacatacggctggaatctcgtgaaacttcacagcgggaaggatgtttttttcatgcctccggagaagtgtgacaccctgctgtgcgatattggagaatcctctcccaaccctacgatcgaggagggccggaccctcagagtgctgaaaatggtcgaaccctggcttcgcggcaatcagttttgtatcaagattctgaacccttatatgcccagcgtggttgagacactcgaacagatgcaacggaaacatgggggaatgctggtgagaaatccgctgtcccgcaactctacccacgagatgtactgggtcagctgcggcacagggaatatcgtgtccgccgtgaacatgaccagccggatgctcctgaacagattcacaatggctcaccgcaagcctacctatgagcgggacgtcgatcttggagccggcacgagacatgttgcggtggaacccgaggtggccaatctggacattatcgggcagcgcattgaaaacatcaaaaatgagcacaagtctacatggcattacgatgaagacaacccctataagacctgggcttaccacggatcctatgaggtcaaacctagcggctctgcctccagcatggtgaatggcgttgtgagactcctgaccaagccctgggatgtcattcctatggtgacacagatcgctatgacggacaccacaccgtttgggcaacagcgggttttcaaagagaaggtggacacccgcacacccagagccaaacggggaaccacacagatcatggaagtcaccgctaagtggctttggggctttctgtctagaaacaagaaacctcggatttgtacgcgcgaggaattcaccagaaaggtgcggtccaatgccgcgatcggggccgtttttgtggatgagaaccagtggaatagcgctaaagaagccgtcgaggacgagcgcttctgggatctcgtgcacagagaacgggagctgcataagcaaggaaaatgcgctacatgcgtctacaacatgatgggcaagcgcgaaaagaaactgggggagtttggcaaggccaaaggatccagagccatttggtacatgtggctcggcgcgcggttcctggaattcgaggctcttgggtttatgaatgaggaccactggttcagccgcgaaaactctctgagcggagtggagggcgaagggctccataagctgggatatatccttagagatatttccaaaatccccggcgggaatatgtacgccgacgataccgccggctgggacacacggatcaccgaggatgacctgcagaacgaggctaagattacggatatcatggaacctgagcacgccctcctggctacatctatttttaaactgacctatcagaataaggttgtgcgcgtccagagacccgccaagaacggaacagtgatggacgtgatcagccggcgcgatcaaagaggctccgggcaggttggaacctacggcctcaacacgttcaccaatatggaagtgcagctgattcggcagatggagtctgaagggatctttcttccgagcgagctggagacacctaacctcgcggaaagagtcctggactggcttgagaaacatggagccgaacgcctgaagcggatggctatctccggcgacgattgtgtggttaaacccattgacgatagattcgccgctgccctcaccgcgctgaatgacatggggaaggtgcgcaaagatatccctcaatgggagccctctaagggctggaacgactggcagcaggtccctttttgcagccaccacttccatcagctgattatgaaggatggacgggaaatcgtggtcccctgtagaaatcaagacgagctcgtgggccgcgcccgggtttcccagggggctggatggagcctgagagagacagcctgccttggcaaatcttatgctcagatgtggcaactgatgtactttcaccgccgggatctcagactggccgctaacgccatttgttccgcggtgccggtcgactgggtgcctaccagccgcacaacctggtctatccatgcccaccaccagtggatgacgacagaagatatgctttccgtttggaatcgggtgtggatcgaggaaaacccctggatggaggacaagacccatgtcagctcctgggaagaggtgccctatctggggaaaagagaggaccagtggtgcggatctctcattggcctgaccgctcgggccacatgggccaccaatatccaggtggctattaaccaagttagacgcctgatcgggaatgaaaactacctcgattacatgacaagcatgaagcggttcaaaaatgagtccgaccctgaaggcgccctgtggtga

SEQ ID NO: 18517 - RNA, 9879 nt, synthetic construct
  misc_feature 1..9879: note = derived and/or modified CDS sequence (opt5) from DENV-1__KJ189302__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagagcaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaaggggatgtcctatgtgatgtgtacgggcagcttcaaactggagaaggaagtcgccgagacacagcacggaaccgtgctggttcaggtgaagtacgagggcaccgatgcgccgtgcaaaattcctttttctacacaagacgaaaagggggtcacccagaacggacggcttatcacagctaatcccatcgtgacggataaagagaagcctgtgaacattgaaaccgagccccccttcggcgagtcctatatcgttgtcggggccggagaaaaagccctcaagctgagctggtttaagaaaggctctagcattgggaagatgttcgaggctacagccagaggcgctcgccggatggccatcctgggagacaccgcgtgggattttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctgtccgccgcgattggcaaggcctgggaggagggggtgtgcggcatcagatctgctacgcgcctcgaaaatattatgtggaaacagatcagcaacgagctgaatcatatccttctggaaaacgacatgaagtttacagtcgtggtgggagacgccaatggcattctcgctcaggggaaaaagatgatccggccgcaacccatggagcacaaatactcctggaagtcttggggaaaggccaaaattatcggcgccgatattcagaacaccaccttcatcatcgacgggcctgatacacccgaatgtcctgacggacagagagcttggaatatttgggaggtcgaggattatggctttggcatcttcaccacgaacatttggctgaagctgcgcgacagctacacacagatgtgcgatcaccggcttatgtccgcggccatcaaagacagcaaggctgttcatgccgatatggggtattggattgaatctgagaaaaatgaaacctggaagctcgccagagcttccttcatcgaggtgaagacatgtacctggcccaaaagccacacactgtggtctaacggagtgctggaatccgagatgatcattccgaagatctacggcgggcctattagccaacataattatcgccccggatactttacccagacggccggcccttggcacctcgggaaactggagcttgacttcgatctgtgcgaaggaaccacagtcgtggttgacgagcactgcggcaaccggggcccctctctcagaaccacaaccgtgacggggaagatcattcatgaatggtgttgccggagctgtacactgcctcccctgcgctttagaggagaggatggctgctggtacgggatggagatccggccggtcaaagaaaaggaggaaaatcttgtgagatccatggttagcgcgggatctggcgaggtggactccttcagcctcgggatcctgtgtgtctccattatgatcgaagaggtgatgcgctctcggtggagcagaaagatgctgatgaccggaacactcgctgtttttctgcttctgattatgggccagctcacctggaacgacctgatccgcctgtgcattatggtgggcgccaatgcctccgatagaatggggatgggaaccacatatcttgctctgatggccacgttcaaaatgcggcctatgtttgcggtcggcctcctgttccgcagactcacctctcgggaggtgctgcttctgacaatcgggctcagcctggtggcttccgtcgaactgcccaactctcttgaggaactgggagacggcctcgccatggggattatgatgctgaagctcctgaccgagtttcaaccccaccagctttggacaaccctgctcagcctgacgttcgttaaaacaaccctgtcccttgattacgcctggaagaccacagctatggtgctgagcatcgtgtctctctttcctctgtgtctctccaccacaagccagaaaacgacctggctgccggtccttctgggatctttcggctgcaagcccctgacaatgtttctcatcaccgaaaacaagatttggggccgcaaatcctggcctctgaatgaggggatcatggccattggaatcgtgagcattcttctgtcttccctcctgaagaacgacgttcccctcgctggccctctgatcgccgggggaatgcttatcgcgtgttatgtgattagcggctccagcgccgatctgtctctggagaaagctgccgaagtcagctgggagcaggaagctgagcattccggggcctctcacaatatcctcgtggaagttcaagacgatggaacaatgaagattaaagacgaggagagagatgacaccctgacgatccttctgaaggccaccctcctggctgtgagcggcgtctaccccatgtccattcctgcgacactcttcgtgtggtatttctggcagaaaaagaagcagcggtctggcgtcctgtgggatacccccagcccgcctgaagtggagcgcgccgttcttgacgatgggatctacagaatcctgcagcggggactgctcggccgctcccaagtgggggtcggagtgtttcaggacggcgttttccatacaatgtggcacgtgaccagaggggctgtcctgatgtatcagggaaaacggcttgaaccctcttgggccagcgtgaagaaagacctgatttcctacggcggcgggtggagatttcagggaagctggaacacaggcgaggaggtgcaagttatcgccgtcgaacctgggaagaatcccaaaaacgtgcagacgaccccgggaacattcaagacccctgagggcgaagtgggggctattgccctcgattttaagcccggaacctctggctcccctatcgtcaatcgcgagggcaaaattgtggggctgtacggaaacggcgttgtgacaacgagcgggacctatgtctctgcgatcgctcaggccaaggcctcccaagaaggacccctccccgagattgaggacgaagtgttcaaaaagcggaatctgacaatcatggatcttcaccctggcagcgggaaaaccagacgctacctgccggctatcgttcgggaggccattaagagaaagctgcgcacactcatcctggcgcccacccgggtggtcgcttccgaaatggccgaggcccttaaaggcatgcctattagatatcagacgacagctgtgaagtctgaacataccggacgcgagatcgttgacctgatgtgccacgccacctttacaatgcggctcctgagccccgtgagagtccctaactacaatatgattatcatggatgaggctcatttcaccgaccccgcctccatcgcggcccggggctatattagcacacgcgtggggatgggagaagctgccgctatctttatgaccgccacgcctccgggctctgtggaggccttcccccagtccaacgctgtcattcaggatgaagagagagacatccctgaacggagctggaattctgggtacgattggattacagactttcccggaaaaaccgtttggttcgtgcctagcatcaagtccggcaacgatatcgcgaattgtctgcgcaaaaacgggaagagagtgattcaactctctcggaagacattcgacaccgagtatcagaaaacgaagaacaatgactgggattacgtcgtgaccacagacatcagcgagatgggcgccaactttagagctgatcgcgttattgacccccggagatgccttaaaccggtgatcctgaaggatggacctgaacgcgtcattctggccggccccatgcccgtgaccgttgcctccgctgcccagcggagagggcgcatcggacggaatcagaacaaagagggcgaccaatacgtgtatatggggcagcctctcaataacgatgaagaccacgcgcattggacagaggctaagatgctgcttgataatattaacacccccgagggaatcatccctgccctgttcgaaccggagagagaaaagtctgccgctattgacggcgagtaccgcctcagaggggaagcccggaaaacatttgtcgagctgatgcgcagaggcgatctgcccgtgtggctcagctataaggtcgcgtccgagggattccagtacagcgaccggcgctggtgctttgatggcgaaagaaataaccaggtgcttgaggaaaatatggacgttgagatctggaccaaagaaggggagcggaagaaactgagacctcgctggctggacgcccggacgtattctgatcccctcgctctgagagagttcaaggaatttgccgctggacgccggtccgtgagcggcgaccttattctggagatcgggaaactccctcaacacctgacactgagagcccagaacgctctcgataatcttgtgatgctgcacaactccgaacagggaggcaaggcctaccggcatgcgatggaggaactgcccgacaccattgagaccctcatgctgcttgccctgatcgctgtcctcacaggcggggttaccctgttctttctgtctggaaagggcctcgggaaaacaagcatcggacttctgtgtgtgacggcctcctctgctctgctctggatggccagcgtggagccgcactggattgccgcttccatcattctggaattctttcttatggtcctgctcatccctgagcccgatcgccagagaacccctcaagacaatcagctggcgtatgtggttattggcctgctcttcatgatccttacagtggccgctaacgaaatggggctgctggagaccacaaagaaagatctcggaatcggctacgtcgccgccgagaaccatcagcacgctaccatgctggacgtggatcttcggcccgccagcgcgtggacgctgtacgccgtcgctaccacagtgattacccctatgatgcgccacacaatcgaaaataccacggccaacatttctctcacagctatcgccaatcaagcggccattctgatgggcctggacaaggggtggcccatctccaaaatggatattggagttccgctccttgctctgggctgctatagccaggtgaaccctctgaccctcacagccgctgtcctgatgcttgtggcccattacgctatcatcgggcccggactgcaggccaaggcgaccagagaggcccagaagcggaccgctgccggcattatgaaaaatcccacagttgacgggatcgtggctattgatctcgaccctgtcgtgtatgacgccaagtttgaaaaacaactgggacagatcatgctgctcattctttgtacgtctcagatcctgctgatgcgcaccacatgggccctctgcgagtccatcaccctggcgacaggcccgcttaccacgctgtgggaaggcagccccgggaagttctggaacacaaccattgctgtgtctatggccaatatcttcagaggaagctacctcgctggcgccgggctggccttttccctgatgaaatctctcggaggcgggcggcgcggaaccggcgctcagggcgagacacttggggagaagtggaagagacaactgaaccagctgagcaaatccgaattcaatacctataagcggagcggaattatggaggttgatagatccgaagccaaagagggcctcaagcgcggggaaacaacgaaacacgcggtctctcggggaaccgccaagctgagatggtttgtggagcgcaaccttgtgaagcctgagggcaaagtcatcgacctggggtgtggacggggcggctggagctactattgcgctgggctcaagaaagttacagaagtgaagggatacaccaaaggcgggcccggacatgaggaacctattcccatggccacatacggctggaatctggtgaagctgcactccgggaaagatgtcttctttatgcctccggagaagtgtgacaccctcctttgcgatatcggagaatctagcccctcccctacgatcgaggagggcagaaccctgcgcgtgctgaagatggttgaaccctggctccggggcaaccagttctgtattaaaatcctgaatccttatatgccctctgtggtcgagacacttgaacagatgcaaagaaagcatgggggaatgctggtgcgcaacccgctcagccggaattccacccacgagatgtactgggttagctgcggcacagggaacattgtgtctgctgtcaatatgacctccagaatgctgctgaaccgctttacaatggcccaccggaaacctacctatgagagagacgtggatctcggagcgggcacgcgccatgtggccgtcgaacccgaggttgctaacctggacatcattgggcagagaatcgaaaatattaagaacgagcacaaaagcacatggcattacgatgaagacaatccctataagacctgggcctaccacggatcttatgaggtgaagccttccggcagcgcttcttccatggtgaacggcgtcgtgcggcttctgaccaaaccctgggatgttatccctatggtgacacagatcgccatgacggacaccacaccgttcgggcaacagcgcgtctttaaggagaaagtggacaccagaacaccccgggctaagagaggaaccacacagattatggaagttaccgccaaatggctctggggcttcctgagccggaataagaagcctcgcatctgtacgagagaggaatttacccggaaagtgcgctccaacgcggccattggggctgtcttcgtggatgagaatcagtggaacagcgccaaggaagctgttgaggacgagagattttgggatcttgtgcaccgggaacgcgagctgcataaacaaggaaagtgcgccacatgcgtctacaatatgatgggcaaaagagaaaagaagctcggggagttcggcaaagccaagggatctcgggcgatctggtacatgtggctgggcgctcgcttcctggaatttgaggccctcgggttcatgaacgaggaccactggtttagcagagaaaattccctgtctggagtggagggcgaagggcttcataaactgggatatattctccgggatatcagcaagatccccggcgggaacatgtacgccgacgataccgctggctgggacacacgcattaccgaggatgacctgcagaatgaggccaaaatcacggatattatggaacctgagcacgctcttctggccacatccatcttcaagctcacctatcagaacaaagtcgtgagagttcagcggcccgcgaagaatggaacagtgatggacgtcatttctcgcagagatcaacggggcagcgggcaggtgggaacctacggcctgaacacgtttaccaacatggaagtgcagctgatcagacagatggagtccgaagggatcttcctcccgtctgagctggagacacctaatcttgccgaacgcgttctggactggctcgagaagcatggagctgaacggctgaaaagaatggccattagcggcgacgattgtgtggtcaagcccatcgacgatcgctttgctaccgcccttacagcgctgaacgacatggggaaagtgcggaaggatattcctcaatgggagccctccaaaggctggaatgactggcagcaggttcctttctgcagccaccactttcatcagctcatcatgaaggatggaagagaaattgtggtcccctgtcgcaaccaagacgagctggtgggccgggccagagtctctcagggggctggatggtccctgcgcgagaccgcctgcctcggcaagagctatgctcagatgtggcaactgatgtacttccaccggagagatcttcgcctggccgctaatgccatctgttctgcggtgccggttgactgggtgcctacatcccggaccacgtggagcatccatgcccaccaccagtggatgacaaccgaagatatgctctccgtctggaacagagtgtggattgaggaaaatccctggatggaggacaaaacccatgtttctagctgggaagaggtgccctatctggggaagcgggaggaccagtggtgcggatcccttatcggcctgacagctagagccacctgggccacaaacattcaggtcgctatcaatcaagtgcgccggctcattgggaacgaaaattacctggattacatgacgagcatgaaaagatttaagaacgagtctgaccctgaaggcgccctgtggtga

SEQ ID NO: 18518 - RNA, 9879 nt, synthetic construct
  misc_feature 1..9879: note = derived and/or modified CDS sequence (opt5) from DENV-1__KJ189303__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaatatgtgcaccctgattgcgatggacctcggggaactgtgtgaagatacaatgacctacaagtgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgtcattgggacatctatcacccagaagggaatcattttcatcctgcttatgctggtgacccctagcatggccatgagatgcgttggcattgggaatcgggattttgtggagggactctccggcgctacatgggtcgacgtggtgctggagcacgggagctgtgtcacgaccatggccaagaataaacccacactggatatcgaactcctgaagaccgaggttacaaaccctgctgtgcttcgcaaactgtgcattgaagccaagatctctaataccacgacagactccagatgtccgacccaaggagaggcgaccctcgtggaagaacaggatgccaacttcgtctgccggcgcacatttgtggacagaggctggggcaatgggtgtggactgttcggcaaagggagccttctgacctgcgctaagtttaagtgcgttacaaaactcgagggaaagattgtgcagtacgaaaacctgaaatattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggccagcacatcccaagagacctggaatcgccaggatctgctggtcacattcaaaaccgctcacgcgaagaagcaggaagtggttgtgctcggatctcaagagggcgccatgcacaccgctctgacaggggccacggaaattcagaccagcggaacaaccacaatctttgccggccatcttaaatgcagactgaagatggacaaactcaccctgaaggggatgtcctatgtcatgtgtacgggcagcttcaaactggagaaggaagtggctgagacacagcacggaaccgttcttgtgcaggtcaagtacgagggcaccgatgccccgtgcaaaattcctttctctacacaagacgaaaagggggtgacccagaacggacggctcatcacagcgaatcccatcgtgacggataaagagaagcctgttaacattgaaaccgagccgccctttggcgagtcctatatcgtcgtgggggctggagaaaaagccctgaagctgagctggttcaagaaaggctctagcattgggaagatgtttgaggccacagctagaggcgcccgccggatggctatcctcggagacaccgcctgggatttcggctccattgggggagtgtttacatctgtcggcaaactggtgcatcaggttttcgggaccgcgtacggagtgctttttagcggcgtctcctggacgatgaagatcgggatcggcattctgctcacctggctgggactgaatagcagatctacatcccttagcatgacctgtatcgccgtgggcatggttacactctacctgggggtgatggtccaggctgactctggatgcgtgattaactggaaaggccgcgaactgaagtgtgggtccggaatcttcgttaccaacgaggtgcacacatggaccgaacaatataagtttcaggccgatagccctaaacggctctccgctgccattggcaaggcgtgggaggagggggtctgcggcatcagatctgccacgcgcctggaaaatattatgtggaaacagatcagcaacgagcttaatcatatcctgctcgaaaacgacatgaagttcacagtggtggtcggagacgctaatggcattctggcccaggggaaaaagatgatccggccgcaacccatggagcacaaatactcctggaagtcttggggaaaggctaaaattatcggcgccgatacccagaacaccacatttattatcgacgggcctgatacccccgaatgtcctgacggacagagagcctggaatatctgggaggttgaggattatggcttcggcatttttacgacaaacatctggctgaaacttcgcgacagctacacccagatgtgcgatcaccggctcatgtccgctgcgattaaagacagcaaggccgtgcatgctgatatggggtattggatcgaatctgagaaaaatgaaacatggaagctggccagagcctccttcattgaggtgaagacctgtacatggcccaaaagccacaccctgtggtctaacggagtcctcgaatccgagatgatcatcccgaagatttacggcgggcctatcagccaacataattatcgccccggatacttcacgcagaccgctggcccttggcacctggggaaacttgagctggactttgatctctgcgaaggaacaaccgtggttgtggacgagcactgcggcaaccggggcccctctctgagaacaaccacggtcacagggaagattatccatgaatggtgttgccggagctgtaccctgcctccccttcgcttcagaggagaggatggctgctggtacgggatggagattcggccggtgaaagaaaaggaggaaaatctcgttagatccatggtgagcgccggatctggcgaggtcgactcctttagcctggggatcctgtgtgtgtccatcatgattgaagaggttatgcgctctcggtggagcagaaagatgctcatgacaggaaccctggcggtgttccttctgctcatcatgggccagctgacctggaacgacctgacacgcctttgcattatggtcggcgctaatgcctccgatagaatggggatgggaacgacctatctggccctcatggctacatttaaaatgcggcctatgttcgccgtgggcctgctctttcgcagactgacctctcgggaggtgcttctgctcacaatcgggctgagcctggtcgcgtccgttgaacttcccaactctctggaggaactcggagacggcctggctatggggattatgatgctcaagctgcttaccgagttccaaccccaccagctgtggacgacactcctgagcctgacctttgtgaaaaccacactttccctggattacgcctggaagaccacagccatggtgctcagcatcgtctctctgttccctctctgtctgtccacgaccagccagaaaacaacctggcttccggtgctgctgggatcttttggctgcaagcccctcacaatgttcctgattaccgaaaacaagatctggggccgcaaatcctggcctcttaatgaggggatcatggctattggaatcgttagcattctgctctcttccctgctcaagaacgacgtgcccctggccggccctcttatcgctgggggaatgctgattgcctgttatgtcatcagcggctccagcgcggatctgtctctcgagaaagccgctgaagtgagctgggagcaggaagccgagcattccggggcttctcacaatatcctggttgaagtgcaagacgatggaacgatgaagattaaagacgaggagagagatgacacccttacaatcctgctcaaggccaccctgctcgccgtcagcggcgtgtaccccatgtccattcctgctacactgtttgtctggtatttctggcagaaaaagaagcagcggtctggcgtgctttgggatacccccagcccgcctgaagttgagcgcgcggtgctggacgatgggatctaccgcattctgcagcggggactcctgggccgctcccaagtcggggtgggagttttccaggacggcgtgtttcatacaatgtggcacgtcacgagaggggccgtgcttatgtatcagggaaaacggctggaaccctcttgggctagcgtgaagaaagacctcatctcctacggcggcgggtggagattccagggaagctggaacaccggcgaggaggttcaagtcatcgccgtggaacctgggaagaatcccaaaaacgtgcagacaaccccgggaacctttaagacacctgagggcgaagtcggggccattgctctggatttcaagcccggaacgtctggctcccctatcgtgaatcgcgagggcaaaattgttgggctctacggaaacggcgtggtcaccacaagcgggacctatgtgtctgccatcgcgcaggctaaggcctcccaagaaggacccctgcccgagattgaggacgaagtttttaaaaagcggaatcttacaatcatggatctgcaccctggcagcgggaaaaccagacgctacctgccggccattgtgcgggaggctatcaagagaaagctccgcacgctgatccttgcccccacacgggtcgtggcgtccgaaatggctgaggccctgaaaggcatgcctattagatatcagaccaccgccgttaagtctgaacatacaggacgcgagatcgtggacctcatgtgccacgctaccttcacaatgcggctgctgagccccgtcagagtgcctaactacaatatgattatcatggatgaggcccattttaccgaccccgcttccattgccgcgcggggctatatcagcacgcgcgtggggatgggagaagccgctgccatcttcatgacagctacccctccgggctctgtcgaggcctttccccagtccaacgccgttattcaggatgaagagagagacatccctgaacggagctggaactctgggtacgattggattacagacttccccggaaaaaccgtgtggtttgtgcctagcatcaagtccggcaacgatattgctaattgtctccgcaaaaacgggaagagagtcatccaactttctcggaagacgttcgacaccgagtatcagaaaacaaagaacaatgactgggattacgtggttaccacagacatcagcgagatgggcgcgaacttcagagccgatcgcgtgattgacccccggagatgcctgaaaccggtcatcctgaaggatggacctgaacgcgtgattctcgctggccccatgcccgttaccgtggcctccgccgctcagcggagagggcgcatcggacggaatcagaacaaagagggcgaccaatacgtctatatggggcagcctctgaataacgatgaagaccacgcccattggacagaggcgaagatgcttctggataatattaacacccccgagggaatcattcctgctctctttgaaccggagagagaaaagtctgccgccgtggacggcgagtaccgcctgagaggggaagctcggaaaacgttcgtcgagctgatgcgcagaggcgatctccccgtgtggcttagctataaggttgcctccgagggatttcagtacagcgaccggcgctggtgcttcgatggcgaaagaaataaccaggtgctggaggaaaatatggacgtggagatctggacaaaagaaggggagcggaagaaactgagacctcgctggctcgacgcgcggacctattctgatcccctggcccttagagagtttaaggagttcgctgccggacgccggtccgtcagcggcgacctgatcctcgagattgggaaactgcctcaacacctgaccctcagagctcagaacgcccttgataatctggttatgctgcacaactccgaacagggaggcaaggcttaccggcatgccatggaggaactccccgacacaatcgagaccctgatgcttctggcgctcattgccgtgctgacaggcggggtgacgctgtttttcctctctggaaagggccttgggaaaaccagcatcggactgctgtgtgtcacagcttcctctgccctcctgtggatggctagcgtggagccgcactggattgccgcctccatcatccttgaatttttcctgatggttctcctgattcctgagcccgatcgccagagaacccctcaagacaatcagctggcttatgtggtcatcggcctcctttttatgattctgacagtggcggccaacgaaatggggctgctcgagaccacgaagaaagatctgggaatcggctacgtcgctgccgagaaccatcagcacgccaccatgcttgacgtggatctgcggcccgctagcgcctggacactctacgcggttgccaccacagtgattacccctatgatgcgccacacgatcgaaaatacaaccgctaacatctctctgacagccattgctaatcaagccgcgatcctgatgggcctcgacaaggggtggcccatttccaaaatggatatcggagtcccgcttctggccctgggctgctatagccaggtgaaccctctcaccctgaccgctgccgttcttatgctggtggctcattacgccattatcgggcccggactccaggctaaggccacaagagaggcgcagaagcggacggccgctggcattatgaaaaatcccaccgtcgacgggatcgtggccatcgatctggaccctgtggtttatgacgctaagttcgaaaaacaactgggacagattatgctccttatcctgtgtacatctcagattctgctcatgcgcaccacatgggccctgtgcgagtccatcacccttgccacgggcccgctgacaaccctctgggaaggcagccccgggaagttttggaacaccacaattgcggtctctatggctaatatcttcagaggaagctacctggccggcgctgggctggccttctccctcatgaaatctcttggaggcgggcggcgcggaaccggcgcccagggcgagacactgggggagaagtggaagagacaactgaaccagctcagcaaatccgaatttaatacgtataagcggagcggaatcatggaggtggatagatccgaagctaaagagggcctgaagcgcggggaaaccacaaaacacgccgtgtctcggggaaccgcgaaacttagatggttcgtcgagcgcaacctggttaagcctgagggcaaagtgattgacctcgggtgtggacggggcggctggagctactattgcgccgggctgaagaaagtgacagaagtcaagggatacaccaaaggcgggcccggacatgaggaacctatccccatggctacgtacggctggaatctggtgaagctccactccgggaaagatgtgtttttcatgcctccggagaagtgtgacacccttctgtgcgatattggagaatctagccccaaccctacaatcgaggagggcagaaccctgcgcgttctcaagatggtcgaaccctggctgcggggcaatcagttttgtattaaaatccttaacccttatatgccctccgtggttgagacactggaacagatgcaaagaaagcatgggggaatgctcgtgcgcaatccgctgtctcggaacagcacccacgagatgtactgggtctcctgcggcacagggaatatcgtgagcgccgtgaacatgacctctagaatgctgctcaaccgcttcacgatggctcaccggaaacctacatatgagagagacgtcgatctgggagccggcacccgccatgttgcggtggaacccgaggtggccaatcttgacattatcgggcagagaattgaaaacatcaagaatgagcacaaatccacctggcattacgatgaagacaacccctataagacatgggcttaccacggaagctatgaggtcaagccttctggctccgccagctctatggtgaatggcgttgtgcggctgctcacgaaaccctgggatgtcattcctatggtgacccagatcgctatgacagacaccacaccgtttgggcaacagcgcgttttcaaggagaaagtggacaccagaacaccccgggccaagagaggaaccacgcagattatggaagtcaccgctaaatggctgtggggctttctttcccggaacaagaagcctcgcatctgtacaagagaggagttcacccggaaagtgcgcagcaatgccgcgatcggggccgtttttgtggatgagaaccagtggaactccgctaaggaagccgtcgaggacgagagattctgggatctggtgcaccgggaacgcgagctccataaacaaggaaagtgcgctacatgcgtctacaacatgatgggcaaaagagaaaagaagctgggggagtttggcaaagccaagggaagccgggccatttggtacatgtggctgggcgcgcgcttcctcgagttcgaggctctggggtttatgaatgaggaccactggttctctagagaaaacagcctttccggagtggagggcgaagggctgcataaactcggatatatcctgcgggatatttctaagatccccggcgggaatatgtacgccgacgataccgccggctgggacacgcgcattacagaggatgaccttcagaacgaggctaaaatcaccgatatcatggaacctgagcacgccctgctcgctacaagcatttttaagctgacctatcagaataaagttgtgagagtccagcggcccgccaagaacggaacggtgatggacgtgatctcccgcagagatcaacggggctctgggcaggttggaacctacggcctgaacacattcaccaatatggaagtgcagctcattagacagatggagagcgaagggatctttctgccgtccgagcttgagacacctaacctggcggaacgcgtcctcgactggctggagaagcatggagccgaacggcttaaaagaatggctatttctggcgacgattgtgtggttaagcccatcgacgatcgcttcgccaccgctctgacagccctcaatgacatggggaaagtgcggaaggatatccctcaatgggagcccagcaaaggctggaacgactggcagcaggtccctttttgctcccaccacttccatcagctgattatgaaggatggaagagaaatcgtggtcccctgtcgcaatcaagacgagctggtgggccgggcgagagttagccagggggccggatggtctctccgcgagaccgcttgcctgggcaagtcctatgcccagatgtggcaacttatgtactttcaccggagagatctgcgcctcgctgccaacgctatttgtagcgccgtgccggtcgaatgggtgcctacgtctcggacaacctggtccatccatgcgcaccaccagtggatgaccacagaggacatgctgagcgtttggaatagagtgtggattgaagagaacccctggatggaagataaaacccatgtctcctcttgggaggaggtgccctatcttgggaagcgggaagaccagtggtgcggaagcctgatcggcctcacagccagagctacgtgggccaccaatatccaggtggccattaaccaagttcgccggctgatcgggaatgagaactacctggactacatgacatccatgaaaagattcaagaatgaaagcgatcctgagggcgctctctggtga

SEQ ID NO: 18519 - RNA, 9879 nt, synthetic construct
  misc_feature 1..9879: note = derived and/or modified CDS sequence (opt5) from DENV-1__KR028435__SS-prME
  source 1..9879: mol_type = other RNA
agcgtgaccatgctgctcatgctgatgcccacagcccttgctttccacctgacgaccagaggaggggaacctcatatgatcgtgtccaagcaggaacgggggaaatctctcctgtttaagaccagcgccggcgttaacatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatttgtacaggctctttcaaactcgagaaggaagtcgccgagacccagcacggaaccgtgctggttcagatcaagtacgagggcacagacgcgccgtgcaaaatccctttctccacccaagatgaaaagggggtgacacagaacggacggctgattacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagttgtggtcggagatgtggctggcatcctcgcccaggggaaaaagatgattcggccgcaacccatggagcacaaatactcttggaaaagctggggaaaggccaagatcatcggcgctgacgtgcagaataccacctttattatcgatgggcctaacacacccgaatgtcctgacgatcagagagcgtggaatatttgggaggtcgaggactatggattcggcatctttaccacgaacatttggctgaagctgcgcgattcctacacacaggtttgcgaccaccggcttatgagcgccgctatcaaagattctaaggccgtgcatgccgacatgggctattggatcgaatccgagaaaaatgaaacctggaagctcgctagagccagcttcattgaggtgaagacatgtatctggcccaaatctcacaccctgtggtccaacggggtcctggaaagcgagatgattatcccgaagatttacggaggccctatctctcaacataattatcgccccgggtacttcacacagaccgcgggaccttggcacctcggcaaactggagcttgattttgacctgtgcgaagggacgaccgtggttgtggatgagcactgcggaaaccggggccccagcctcagaacaaccacagtcaccggcaagatcattcatgaatggtgttgccggtcctgtacgctgcctcccctgcgcttcagaggggaggacggatgctggtacggcatggagatccggccggtgaaagaaaaggaggaaaatcttgttaagagcatggtgtctgctgggtccggagaggtcgacagcttttccctcggcctgctgtgtatttctatcatgattgaagaggtgatgagaagccgctggtcccggaaaatgctcatgacagggaccctggccgttttctttcttctgatcatgggacagctcacatggaacgatctgattagactgtgcatcatggtgggcgccaatgcttctgaccgcatgggcatggggaccacctatcttgccctgatggcgacattcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcattatgatcctgaaactcctgacagactttcaatcccaccagctttgggctaccctgctcagcctgacattcattaagaccacgttttctctgcattacgcctggaaaacaatggctatggttctttccatcgtgagcctgttccccctctgtctgtctaccacctcccagaagacaacctggctccctgtgctgcttgggagcctgggatgcaagccgctgacaatgtttctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttatgtgattagcggatctagcgctgacctgtccctggagaaggccgccgaggtctcttgggaagaggaagctgagcacagcggcgcgtcccataatatcctcgtggaagttcaggatgacgggacgatgaaaatcaaggatgaggagcgcgacgataccctgacaattcttctgaaagccaccctcctggctatctctggagtgtaccctctcagcattcccgccacactgttcgtctggtatttctggcaaaagaagaaacagagatccggcgtgctttgggacaccccttctcccccggaagtcgagcgggccgtgctggatgacggcatctaccgcattatgcagagagggctgctcggacggagccaggttggcgtgggggtctttcaagaaaacgtgttccacacgatgtggcacgttacccgcggagctgtgctgatgtatcagggcaagagacttgagccttcctgggccagcgtcaaaaaggacctgatctcttacgggggaggctggcggctccagggctcctggaatacaggggaggaagtccaggtgattgcggttgagcccggcaaaaatcctaagaatgtccaaaccgctcccggcacatttaagaccccggaaggggaggtgggagccatcgccctggatttcaaacctggcacaagcgggtctcccatcgtgaacagagaaggaaagattgtcggcctctacggcaatggggtggttacgacctccggaacatatgtgagcgctatcgcccaggcgaaggcttcccaggagggccctctgcccgagattgaagacgaggtctttcgcaagcggaaccttaccatcatggatctgcatcccgggtctggaaaaaccagacgctacctgcctgccattgtgcgggaagccatcaagagaaagctccgcacactgatccttgctccgacgcgggttgtggccagcgagatggctgaagccctgaaaggcatgcccattagatatcaaaccacagcggtcaagtccgagcacaccgggaaagagatcgtggacctcatgtgccatgccacattcaccatgcgcctgctgagccctgttcgggtgcccaattacaacatgattatcatggatgaagctcactttacggacccttcttccattgccgctagaggctatatcagcacacgggtcggaatgggcgaggccgccgctatcttcatgaccgcgacaccccctgggtctgtggaagcctttccgcagagcaatgctgtgattcaggatgaggaaggaggcatctccgagcgctcttggaacagcgggtacgagtggattacagacttccccggaaagaccgtctggtttgttccttccatcaaatctggcaatgatattgccaactgtctcagaaagaatgggaagcgggtgatccagcttagccgcaaaacattcgacaccgaatatcaaaagacgaaaaacaacgattgggactacgtggtcacaaccgacatttccgagatgggcgccaatttcagagctgatcgggtgatcgaccccagacgctgcctgaagcctgttatcctgaaagatggacccgaacgggtgattctcgccggcccgatgcctgtcacagtggcgagcgctgcccagagacgcgggcggatcggaagaaaccataataaggagggcgaccagtacatttatatggggcagcccctgaacaatgatgaggaccacgcccactggaccgaagctaagatgcttctggataacatcaatacgcccgagggaattatccctgccctctttgaacccgagcgcgaaaaatctgcggccatcgacggcgagtaccggctgagaggggaggctcgcaagaccttcgttgaactgatgagacggggcgatctccctgtgtggctttcctataaagtcgccagcgagggatttcaatactccgaccgcagatggtgcttcgatggcgaacggaacaatcaggtgctggaggaaaacatggacgtcgagatttggacaaaggagggggaacgcaaaaagctgagaccgcggtggctcgatgctagaacctattctgaccccctggcccttcgcgagtttaaagagttcgctgccggacggagaagcgtgtccggcgacctgatcctcgagattgggaagctgcctcagcatctgacacagcgcgcgcaaaatgccctcgataaccttgttatgctgcacaattctgaacagggaggccgggcttacagacatgccatggaggagctgcccgacaccatcgaaacactcatgctgcttgctctgattgccgtgctcaccggcggggtgacgctgtttttcctgagcggacggggcctcgggaagacatccatcggacttctgtgtgtcatggccagctctgttctgctctggatggcttccgtggagcctcactggatcgcggccagcattatcctggaatttttccttatggtgctgctcattcccgagccggatcgccagagaacccctcaggacaaccaactggcttatgtcgtgatcggcctgctctttatgattcttaccgttgccgccaatgagatggggctgctggaaacaaccaaaaaggatctcggaatcggccacgtggctgtcgagaaccatcaccatgccacaatgctggacgtggatcttcaccccgcgtctgcctggacgctgtacgctgtcgccaccacaattatcacccctatgatgcggcatacaatcgaaaacaccacggctaatatttccctcaccgccatcgcgaaccaggccgctattctgatgggcctggacaaagggtggcccatcagcaagatggatattggagtgcctctccttgccctgggctgctactctcaggttaatcccctgacactcaccgctgccgtgctgatgcttgtcgctcactatgccatcatcgggccgggactgcaagcgaaagccacacgcgaggctcagaagagaaccgccgctggcattatgaagaaccctacggtggacgggatcgttgccattgatctcgaccccgtggtctacgatgccaaattcgaaaagcagctgggacagatcatgctgctcattctttgtacaagccaaatcctgctgatgcggaccacatgggcgctctgcgagtccatcaccctggctaccggcccccttacaacgctgtgggagggctctcctgggaaattttggaataccacaattgccgtgagcatggctaacatcttccgcggatcctatctcgccggcgccgggctggctttcagcctgatgaagtccctcggaggcgggagacggggaaccggcgcccagggcgaaacacttggggagaaatggaagcgccagctgaatcagctgtctaagagcgaatttaacacctacaaaagatccggaattatggaggtggaccggtctgaagcgaaggagggcctcaaaagaggggagacgacaaagcacgccgttagccgcggaaccgctaaactgcggtggttcgtcgaaagaaatcttgtgaagccggagggcaaggtgatcgacctggggtgtggacgcggcggctggtcctattactgcgccgggctcaaaaaggtcaccgaagttaaaggatatacaaagggcgggcccggacatgaggaacctattcccatggctacctacggctggaacctggtgaaactgtactctgggaaggatgtgtttttcatccctcccgagaaatgtgacacactcctttgcgatattggagagagctcccctaatccgacgatcgaagagggccggaccctgagagtcctgaagatggtggaaccctggctccgcggcaaccaattttgtatcaagattctgaatccttatatgcccagcgttgtggagacacttgagcagatgcagcggaaacacgggggaatgctggtcagaaaccctctctctcgcaattccacccatgaaatgtactgggtgagctgcggcacagggaacatcgtttctgccgtgaatatgacctcccggatgctgctgaacagattcacgatggcgcaccgcaagcccacctatgagcgggacgtcgatctcggagccggcacaagacacgtggctgtggaaccggaggtcgccaacctggacattatcgggcagcgcattgaaaatatcaaacatgagcacaagagcacctggcattacgatgaggacaacccttataaaacatgggcttaccacggatcttatgaagttaagccctccggcagcgcctccagcatggtgaatggcgtggtcaaacttctgaccaaaccctgggatgtgatccctatggttacacaaattgctatgaccgacacgacaccctttgggcagcagagagtgttcaaggagaaagtcgatacccggacccctaaggccaaacgcggaacagcgcaaatcatggaagtgacggccagatggctctggggctttctgtctcggaacaagaagccgagaatttgtacccgggaggagttcacacgcaaagttagaagcaatgctgccatcggggctgtgtttattgacgagaaccagtggaactccgccaaggaggccgtcgaagacgagcggttctgggatcttgtgcatcgcgaaagagagctgcacaaacagggaaagtgcgcgacctgcgtttacaacatgatgggcaaacgggaaaagaagctcggggagtttggcaaagctaagggatctcgcgccatctggtacatgtggctgggcgccagattcctggagttcgaagctctcgggtttatgaatgaggaccactggttcagccgggaaaactccctgtctggagtggagggcgaggggcttcataaactgggatatatcctccgcgatattagcaagatccccggcgggaatatgtacgccgacgatacagctggctgggacaccagaattacagaagatgacctgcagaacgaggccaaaatcaccgatattatggaacctgagcacgcgcttctggccaaggctatctttaaactcacgtatcaaaataaggtcgtgcgggtccagcgccccgccaagaacggaaccgtgatggacgttatctccagacgggatcagcgcggctctggacaggtgggaacatacggcctgaataccttcacaaacatggaagctcaactgattagacagatggagagcgaggggatcttttcccctagcgaactcgagacccccaacctggccgaacgggtccttgactggctggagaaatatggagtggaaagactcaagcgcatggcgatttctggcgatgactgtgtggttaaaccgatcgacgatcggttcgccacggctctgacagcccttaatgacatggggaaggtgagaaaagatattcctcagtgggagccctccaagggctggaacgactggcagcaagtccctttttgcagccatcacttccaccagctgatcatgaaggatggacgcgagattgtggttccctgtcggaatcaggacgaactcgtgggcagagctcgcgtctctcagggggccggatggtccctgcgggagaccgcttgcctgggcaaaagctacgcccaaatgtggcagctcatgtattttcatagacgcgatctgcggcttgcggccaacgctatctgttccgccgtgcctgtcgactgggtgcccacatctagaaccacgtggagcatccacgcccatcaccagtggatgaccacagaagatatgctgtccgtttggaatcgcgtgtggattgaggaaaacccgtggatggaggacaagacccatatcagctcttgggaggatgtcccttacctcgggaaacgggaagaccaatggtgcggatccctgattggccttacagctagagccacctgggcgacaaatatccaggtggctattaaccaggttcggagactgatcgggaatgagaactacctcgactatatgaccagcatgaagcgcttcaaaaatgaatctgatcccgagggcgccctgtggtga

SEQ ID NO: 18520 - RNA, 9879 nt, synthetic construct
  misc_feature 1..9879: note = derived and/or modified CDS sequence (opt5) from DENV-1__JQ922548__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttcgccaccccggcttcaccgtgatcgccctgtttctcgcgcatacaattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggcccgcaataagcccaccctggatatcgaactcctgaaaacagaggtcaccaaccctgctgttcttagaaagctgtgcattgaagccaaaatctctaatacgacaaccgactcccggtgtccgacccaaggagaggcgacactcgtggaagagcaggatgccaacttcgtgtgccgcagaacctttgtcgaccggggctggggcaatgggtgtggactgttcggcaaggggagccttctgacatgcgctaaatttaagtgcgtgacgaagctcgagggaaaaattgttcagtacgaaaacctgaagtattctgtgatcgtcaccgtgcacacaggcgatcagcatcaagttgggaatgagaccacagaacacggaaccatcgccacgattaccccccaggctcctatgtccgagatccagctgacagactacggcgccctcaccctggactgtagcccccgcacaggccttgatttcaacgaaatggtgctgctcaccatgaaagagaagtcttggctggtccataaacagtggtttcttgacctgcctctcccctggacgtccggggccagcacatcccaagagacctggaatagacaggatctgctggtgacattcaagaccgctcaggcgaaaaagcaagaagtcgtggttctcggatctcaggagggcgccatgcacaccgctctgacaggggccacggaaattcagaccagcggaacaaccacaatgtttgccggccaccttaagtgccggctgaaaatggacaagctcaccctgaaaggggcttcctatgtgatgtgtacgggcccgttcaagctggagaaagaagtcgccgagacacagcatggaaccgtgcttgttcaagtgaagtacgagggcaccgatgcgccttgcaagatccccttcagcacacaggacgaaaaaggggtcacccagaacggaagactcattacagctaatcctatcgtgacggataaggagaaacccgtgaacatcgaaaccgagcccccttttggcgagtcttatattgttatcggggccggagaaaaggccctgaaactgtcctggttcaagaagggcagctctattgggaaaatgtttgaggctacagcccgcggcgctcggagaatggccatcctcggagacaccgcgtgggatttcggcagcattgggggagcctttacatccgtcggcaagctggtgcaccaggtgttcgggaccgcttacggagtccttttttctggcgtgagctggacgatgaaaatcgggatcggcattctgctcacctggctgggactgaattcccgcagcacatctctttccatgacctgtatcgccgttggcatggtgacactctacctgggggtcatggtgcaagctgacagcggatgcgttattaactggaagggccgggaactgaaatgtgggtctggaatcttcgtgaccaacgaggtccatacatggaccgaacagtataagtttcaggccgattccccgaagagactcagcgcggccattggcaaagcttgggaggagggggtgtgcggcatccgctccgccacgcggctggaaaatattatgtggaagcagatctctaacgagcttaatcacatcctgctcgaaaacgacatgaaattcacagttgtggtcggagacgctaatggcattctgacccaagggaagaaaatgatcagaccccagcctatggagcataagtacagctggaaatcctggggaaaggccaagattatcggcgccgatgctcagaacaccacatttattatcgacgggcccgatacccctgaatgtcccgacgatcagcgcgcgtggaatatctgggaggtggaggactatggattcggcatttttacgacaaacatctggctgaaacttcgggattcttacacccaaatgtgcgaccacagactcatgagcgccgctattaaggattccaaagccgtgcacgccgacatgggctattggatcgaaagcgagaagaatgaaacatggaaactgacccgcgcttctttcattgaggtcaagacatgtacctggccgcggtcccatacgctgtggagcaacggggttctcgaatctgagatgatcatccctaagatttacggaggccccatctcccagcacaattatagacctgggtacttcacccagacagccggaccctggcatctgggcaaacttgagctggattttaacctctgcgaagggaccacagtggtggtcgacgagcactgcggaaatggcggcgcgagcctggggaccacgacagtgaccggaaagattatccacgaatggtgttgccggtcttgtacactgcctccccttcgcttcctcggcgaggatgggtgctggtacggaatggagattagaccggttaaagaaaaggaggaaaacctgtttcggagcatggtgtccgctggcagcggggaggtcgactctttctccctgggactcctgtgtgtgagcatcatgatcgaagaggttatgagatcccgctggtctcggaaaatgcttatgaccggcaccctggccgtgtttttcctcctgattatgggccaactgacatggaatgaccttatcagactgtgcattatggtcggggccaacgctagcgatcgcatcggaatgggcacgacctatctcgccctgatggcgacatttaagatgagacctatgttcgctgtggggctcctgtttcggcgccttacctccagagaggttctgctcctgacaattggactgtctcttgtggccagcgtcgaactgcccaactccctcgaggaactgggcgacgggctcgccatgggaatcatgatgctgaagcttctgaccgatttccagtctcatcagctctggacgacactgctgagccttacctttattaaaaccacactgtccctcgactacgcttggaagaccatcgccatggtgctgagcatcgtgtctctcttccccctgtgtctttccacaacgagccagaaaaccacatggctgcctgtcctgctcggctcttttggctccaagccgctgaccatgttccttattacagagaataaaatctgggggcggaagagctggcccctgaacgaaggaattatggctgttggcatcgtgtctattctcctgtccagcctccctaagaatgatgtgcccctggccgggcctcttatcgcgggaggcatgctgatcgcctgctatgtcatttccgggagctctgctgacctgagcctcgagcgcgccgctgaggtgtcctgggaagaggaagccgagcactctggagccagccataacatcctggttgaagtgcaagatgacggcaatatgaaaattaaggatgaggagagagacgattcccttaccatcctgctcaaagctacgctgctcgcggtctctggcgtgtaccccatgagcattcctgccaccctgttcgtttggtatttttggcagaagaaaaagcagcggtccggggtgctttgggacacaccctctccgcctgaagtcgtgcgcgctgtcctggatgacggaatctacagaatcctgcagcggggcctcctggggcgcagccaagtgggagttggcgtgttccaggacggggtctttcacaccatgtggcatgtgacaagaggagccgttcttatgtatcagggcaaacggctggagccctcctgggccagcgtgaagaaggatctcatttcttacggcgggggatggagattccagggctcctggaacaccggggaagaggtccaagtgatcgctgtggagcctggaaaaaatcccaagaacgttcagacaacgccgggcacctttaaaacacctgaaggggaggtcggagccattgcgctggacttcaagcccggcaccagcggctctcctatcgtgaatcgcgaagggaaaattgtgggactctacggcaacggggtcgtgaccacatccggaacgtatgttagcgctatcgcccaggccaaggcttcccaagagggccccctgcccgaaattgaggatgaggtgtttaagaaacggaatcttaccatcatggacctgcaccctgggtctggcaagacaagacgctacctgccggccatcgtccgggaagcgattaaaagaaagctccgcaccctgatccttgctcccacacgggtggttgccagcgagatggccgaagctctgaaaggaatgcctattagatatcagaccacggccgtgaagtccgagcacacaggccgcgaaatcgtcgatctcatgtgtcatgctaacttcaccatgcggctgctgagccccgtgagagttcctaattacaacatgattatcatggacgaggcccactttaccgatcccgcgtctatcgccgctcgggggtatatttccacacgcgtgggaatgggcgaggccgctgccatcttcatgaccgccacacctccggggagcgtcgaagcttttccccagtctaatgcggtgattcaggacgaggaaagagatatccctgagcggagctggaactccggatacgactggattaccgatttccccggcaagacggtgtggttcgtcccttctatcaaaagcgggaacgacatcgccaattgcctccgcaagaacggcaaaagagttattcaactttcccggaagacatttgacaccgaatatcagaaaacaaagaataacgattgggactacgtggtgaccacggatatctctgagatgggagctaatagcagaaccgaccgcgtcattgatccccggagatgtctgaagccggtgatcctgaaagacggccctgagcgcgttattctcgccgggcccatgcccgtgacagccgcttccgccgcgcagcggagaggacgcatcggccggaaccagaataaggaaggggatcaatacatttatatgggacagcctctgaacaatgacgaggatcatgctcactggaccgaagccaaaatgcttctggacaacatcaatacacccgagggcatcattcctgccctcttcgagccggaaagagagaagagcgctgccatcgatggggaataccgcctgagaggcgaggcgcggaaaacctttgtcgaactgatgcgcagaggagacctccccgtgtggctttcttataaggttgcctccgagggcttccagtacagcgatcggcgctggtgctttgacggggagagaaacaatcaggtgctggaagagaacatggacgtcgaaatttggacaaaggagggagaacggaaaaagctgagacctcgctggctcgatgctcggacctattccgaccccctggcccttagagagttcaaagagtttgctgccggccgccggtctgtgagcggggatctgatcctcgaaattggaaagctgcctcaacatctgacgctcagagctcagaatgcccttgacaacctggtcatgctgcacaactccgagcagggcggcaaagcgtaccggcacgccatggaagagctccccgatacaatcgaaaccctgatgcttctggctctcatcgccgtgctgaccgggggagttacactgttctttctctctggcaaggggcttggaaaaaccagcattggcctgctgtgcgtgatggcttccagcgtgctcctgtggatggcctctgtcgagccgcattggatcgccgcttccattatccttgagttctttctgaaggaactcctgattcctgacgcggatgggcagcgcacaccccaagacaatcagctggcctatgttgtgatcggactccttttcatgatcctgacggtggctgccaacgagatgggcctgctcgaaaccacaaagaaaaatctgggcattgggcacgtcgtggccgagaaccatcaccacgctaccatgcttgatatcgacctgcatcctgccagcgcgtggacactctacgccgttgctaccacgattatcacccccatgatgagacacacaattgagaataccacagccaacatctctctgaccgctattgccaatcaggcggccatcctgatgggactcgataagggccggcctatctccaaaatggacattggggtgccccttctggctctgggatgttacagccaagtcaacccgctcacgctgacagccgctgtgcttatgctggtcgcccattatgctatcattggccctgggctccaggccaaggcgacccgcgaagcccagaaaagaacagctgccggactgatgaagaatcccaccgtggatggcatcgctgccattgacctggaccccgttgtgtacgatgccaagtttgagaaacagctcggccaaatcatgcttctgatcctgtgcacctctcagattctcctgatgcggacaacgtgggcgctttgtgaaagcatcaccctggctacagggcctctcaccacactgtgggagggatccccgggcaagttctggaacaccacgattgccgtctctatggctaatatcttccgcgggagctatctggccggagccggcctcgctttttcccttatgaaaagcctggggggaggcagacggggcacaggggcccagggagaaaccctgggcgagaagtggaaacgccagctcaaccaactgtccaagtctgagttcaatacctacaagagaagcgggattatggaagtggaccggtccgaggcgaaagaaggacttaagagaggcgagacaaccaaacacgccgtttctcgcgggacagctaagctgcggtggtttgtggaaagaaacctcgtcaaacccgagggaaaggtgatcgatctgggctgcggccgcgggggatggagctattactgtgccggcctgaagaaagtgacggaggttaaggggtataccaaaggaggccctgggcatgaagagcccatccctatggctacatacggatggaatctcgtcaagcttcactccggcaaagacgtgttctttaccccccctgaaaagtgcgatacactgctgtgtgacattggcgagtctagcccgaaccccaccatcgaagaggggcggacgctcagagtgctgaaaatggtcgagccttggcttcgcggaaatcagttctgcattaagatcctgaacccctacatgccttccgttgtggaaaccctcgagcagatgcagcggaagcacggcgggatgctggtgagaaaccccctgagccgcaattctacacatgaaatgtattgggtctcctgtgccaccggaaacattgtgagcgcggttaatatgacatctcggatgctcctgaacagatttaccatggcccaccgcaaaccgacatacgagcgggatgtggaccttggcgctgggaccagacatgtcgccgtggagcctgaaatcgctaatctggatattatcggacaacgcatcgagaacattaagaatgaacacaaatccacgtggcactatgacgaggataacccctacaagacatgggcctatcatggcacctacgaagttaaacccagcggctctgcttccagcatggtgaatggggtcgtgagactcctgaccaagccttgggacgtgatccccatggtcacacagattgccatgacggacaccacacctttcggacagcaacgggtttttaaggagaaagtggatacccgcacaccgagacccaagcggggcaccgcgcagatcatggaggtgacagccagatggctttgggggttcctgtcccggaacaaaaagcctcgcatttgcaccagagaagagtttacgcggaaagtccgcagcaatgctgccatcggagctgtgttcgttgacgaaaaccagtggaattctgccaaggaggccgtggaagatgagagattttgggacctcgtccaccgggagcgcgaactgcataagcagggcaaatgtgcgacctgcgtgtataacatgatggggaagagagagaaaaagctgggcgaattcggaaaagctaagggcagccgggccatctggtacatgtggctcggggcccgcttcctggagtttgaagctcttggattcatgaatgaggatcactggttttccagagagaactctctgagcggcgttgaaggggagggactccataagctgggctacattcttcgggacatctccaaaattcccgggggcaacatgtatgccgatgacacagctggatgggatacccgcatcacagaagacgatctgcaaaatgaggccaagattaccgacatcatggagcctgaacacgcgctcctggccacgtctatcttcaaactgacataccagaacaaggtggtcagagtgcagcggcccgctaaaagcggcaccgttatggatgtgatttcccgcagagaccagcgggggtctggacaagtcggcacatatgggctcaatacctttacgaacatggaggtgcagctgatcagacagatggaaagcgagggaattttctccccgagcgaacttgagaattctaacctggccgagcgcgctctcgactggctggaaaagcacggcgtcgagcggcttaaaagaatggccatctccggggatgactgcgtggttaagcctaccgatgaccgctttgcgacagccctgaccgctctcaatgatatgggcaaggtgcggaaagacattccccagtgtgaacctagcaagggatggaacgattggcaacaggtccccttctgctctcatcactttcatcagctgatcatgaaagacggcagagagatcgtggtgccttgtcgcaatcaggatgaactggttgggcgggccagagtgtcccaaggagctggctggagcctccgcgagacagcctgcctggggaagtcctacgctcagatgtggcagcttatgtatttccaccggagagacctgcgcctcgccgcgaacgccatttgttctgctgtccccgtgaattgggttccgaccagccggacaacctggtccatccacgcccatcaccaatggatgacgacagaggatatgctgagcgtgtggaacagagtctggattgaagagaatccttggatggaagacaaaacccatgtgtcttcctgggccgacgtcccctaccttggaaagcgggaggatcagtggtgcggcagcctgatcgggctcgctgccagagcgacctgggctacaaacattcaggtggccctgaatcaggttcgccggctgatcggcaacgaaaactatctcgactacatgacctctatgaagagatttaaaaatgagagcgatcccgagggagccctgtggtga

SEQ ID NO: 18521 - RNA, 9879 nt, synthetic construct
  misc_feature 1..9879: note = derived and/or modified CDS sequence (opt5) from DENV-1__JQ922544__SS-prME
  source 1..9879: mol_type = other RNA
tccgtgaccatgctgctcatgctgcttcccaccgctctggctttccacctcacgacccggggcggggaacctcatatgatcgtctccaagcaggaacggggaaagtctctgctttttaagaccagcgccggcgttaacatgtgcaccctgattgcgatggacctcggggaactgtgtgaagatacaatgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctgcgagggcgcctggaaacagattcagaaggttgaaatctgggcccttcggcaccccggcttcacagtgattgccctgtttctcgcgcatgccatcgggacctccatcacacagaagggaattatcttcattctgcttatgctggtcaccccttctatggctatgcgctgtgtgggcatcgggaacagagagtttgttgagggactcagcggcgccacctgggtggatgtcgtgctggaacacgggtcctgcctgcacacaatggctcaaaataaacccacgctcgacattgagctgcttaagaccgaagtgacaaaccctgccgtcctgcggaaactctgtatcgaggcgaagattagcaataccacaaccgattctcgctgcccgacgcagggagaagccacactggttgaggagcaggacgctaacttcgtgtgtagacggacctttgtggatcgcggctggggcaatgggtgcggacttttcggcaaagggtccctgctcacatgcgccaagtttaagtgtgtcacaaaactggaaggaaagatcgtgcagtacgagaacctgaaatatagcgttatcgtgaccgtccatacaggcgaccaacaccaggtggggaatgaaacgaccacacatggaaccattgctacaatcacaccccaggcccctacgtctgagattcagctcaccgattacggcgccctgacacttgactgctcccccagaaccggcctggacttcaacgaaatggttctcctgacaatgaaggagaaaagctggcttgtgcacaagcaatggtttctggatctccctctgccctggacctctggggcttccacgagccaggagacatggaatcggcaggacctgctcgtcaccttcaaaacagcgcacgccaagaagcaagaagtggtcgtgctgggatcccaggagggcgctatgcataccgcccttaccggggccacagaaatccagacgtctggaaccacaaccatttttgctggccacctgaaatgtcgcctcaagatggataaactgacactgaaggggatgagctatgttatgtgcaccggctccttcaaacttgagaaggaagtggccgagacgcagcatggaacagtcctcgtgcaagttaagtacgagggcaccgacgcgccgtgtaaaatccctttcagcacccaggatgaaaagggggtgacacagaacggaagactgatcaccgctaatcccattgtcacagacaaagagaagcctgtgaacatcgaagccgagccgccctttggcgagtcttatattgtggttggggccggagaaaaagctctgaagctctcctggttcaagaaaggcagctctatcgggaagatgtttgaggccacggctcggggcgccagacgcatggcgattctgggagataccgcctgggacttcggcagcatcgggggagtctttacatccgtgggcaaacttgtgcaccaggtcttcgggaccgcttacggagtgctgttttctggcgttagctggatcatgaagattgggatcggcattctcctgacatggctgggacttaattcccggagcacctctctctccatgacgtgcatcgccgtgggcatggtcaccctgtacctgggggtgatggttcaagctgatagcggatgtgtgattaactggaaaggcagagaactcaagtgcgggtctggaatcttcgtcacaaacgaggtgcatacctggacagaacagtataagtttcaggccgactcccctaaacgcctgagcgcggccattggcaaggcttgggaggagggggtttgtggcatccggtccgccaccagacttgaaaatatcatgtggaaacagatttctaacgagctgaatcacatcctcctggaaaacgatatgaagttcacagtggtcgtgggagacgctaatggcattctggcccaagggaaaaagatgatccgcccgcagcccatggagcacaaatacagctggaagtcctggggaaaggccaaaattatcggcgctgacatccagaacaccacgtttattatcgatgggcctgacacacccgaatgccctgatgaccagcgggcgtggaatatttgggaggtggaggattatggattcggcatctttaccaccaacatttggcttaagctcagagactcttacacacaaatgtgtgatcatcgcctgatgagcgccgctatcaaagactccaaggccgtccacgccgatatgggctattggatcgaaagcgagaaaaatgaaacctggaagctggctcgggcctctttcattgaggttaagacgtgcatctggcccaaatcccatacactctggagcaacggggtgctggaatctgagatgattatcccgaagatttacggaggccctatctcccagcacaattatagacccgggtacttcacccagacagcgggaccttggcaccttggcaaactggagctcgactttgatctgtgcgaagggaccacagtggtcgtggaggaacattgtggaaaccgcggccccagcctgcggaccacgaccgttacaggcaagatcattcacgagtggtgctgtagatcttgcacccttcctcccctccggttcaaaggggaggacggatgttggtacggcatggaaatccgcccggtgaaggagaaggaagagaatctggtcagaagcatggtgtccgctgggagcggagaagttgattctttttccctgggcctcctgtgcgtgagcattatgatcgaggaggtcatgcggtccagatggtctcgcaaaatgcttatgacagggaccctggccgtgttcctcctgctgattatgggacaacttacgtggaacgacctgatccggctctgtattatggttggcgccaatgctagcgacagaatgggcatggggacaacctatctggccctcatggcgacatttaagatgcgccctatgttcgctgtgggactgctttttagacggctgacctcccgcgaagtcctcctgctgaccatcggcctttctctggtggccagcgtggagctccccaactccctggaagaacttggggatggactggccatgggcatcatgatgcttaaactgctcacagacttccagtctcatcagctgtggacgaccctgcttagcctgacatttattaagaccacactctccctggattacgcttggaaaaccatggccatggtcctcagcatcgtttctctgttccccctttgcctgtccacgacaagccagaagaccacctggctgcctgtgctcctggggtcttttggatgtaagccgcttacaatgttcctgattaccgaaaacaaaatctggggcagaaagtcctggcccctcaatgagggcattatggctgtggggatcgtcagcatcctgctctcttccctgcttaaaaacgacgtgcctctggccggacccctgattgcgggcgggatgctcatcagctttttcgttatttccggaagctctgccgatctgagccttgagaaggctgccgaagtgtcctgggaggaagaggctgaacactctggcacaagccataatatcctggtcgaggtgcaagacgatgggacgatgaaaattaaggacgaggaacgggatgacaccctcacaatcctgctcaaagccaccctgcttgccgtttccggagtgtatcctatgtctatccccgctacactgttcgtctggtacttttggcagaagaagaaacagcgcagcggcgtgctgtgggatacccctagccctcccgaggtcgaaagagcggtgctcgacgatggcatttatcggatcctgcagcgcgggcttctgggaagatctcaagttggcgtgggggtcttccaggacggagtgtttcacacgatgtggcacgttacccggggcgccgtgctcatgtaccaggggaagcgcctggagcccagctgggcttccgtcaaaaaggacctcattagctatggaggcggctggagattccaggggtcttggaacacaggagaggaagtgcaagtgatcgccgttgagcccggcaaaaatcctaagaacgtccagaccacacccgggacctttaagacaccggaaggagaggtgggcgccattgctctggatttcaaacctgggacgtccggaagccccatcgtgaatcgggaaggcaagattgtcggcctttacgggaacggagtggttaccacatctggcacctacgtgtccgccatcgcgcaggctaaagccagccaagaggggcctctgcccgagatcgaagacgaggtctttagaaagcgcaatctgaccattatggatctccatcccggatccggcaaaacacggagatatctgcctgccatcgtgcgcgaagctattaagcggaaacttagaacgctgatcctcgccccgacccgcgttgtggcgtctgagatggctgaagccctgaaagggatgcccattcggtaccagacaaccgccgtcaagagcgagcacacaggcagagagatcgtggacctgatgtgccatgctaccttcacgatgcgcctcctttcccctgttcgggtgcccaactataatatgatcattatggatgaagcccactttacagaccctgctagcatcgccgcgagaggatacatttctacccgggtcggcatgggggaggccgctgccatcttcatgaccgctacaccccctggatccgtggaagcctttccgcagagcaacgccgtgattcaggatgaggaacgcgacatccccgagagatcttggaatagcggctatgattggatcaccgacttccctgggaaaacagtctggttcgttccctccattaagtctggaaacgatatcgctaattgtctgcggaaaaacggcaagcgcgtgattcaactgagcagaaagacctttgacacggagtaccagaaaacaaagaacaatgactgggattatgtggtcaccacagacatctccgaaatgggggcgaacttccgggccgatagagtgattgaccctcgccggtgcctcaaacccgttatcctgaaggatggcccggagagagtgattcttgctggacctatgcccgtcaccgtggcctctgccgctcagcgccggggcagaatcgggcgcaatcagaacaaagaaggagaccaatacgttaatatgggccagcccctgaacaatgatgaggaccatgcccactggacggaggcgaagatgctcctggataacatcaatacccctgaagggattatccccgctctgtttgagcctgaacggaagaaaagcgccgccgtggacggagagtacagactccgcggcgaagctagaaagacattcgtcgagcttatgcggcgcggggatctgccggtgtggctgtcctataaagtcgccagcgagggctttcagtactctgacagacggtggtgcttcgatggagaacgcaacaatcaggtgctcgaggaaaacatggacgttgagatttggaccaaggaaagagagcggaaaaagctgagaccccgctggcttgacgcgcggacatattccgatcctctggccctcagagagtttaaagagttcgctgccggccgccggagcgtgtccggggacctgatcctggagattggaaagctcccccaacaccttaccctgagagctcagaatgccctggataacctcgtgatgctgcataattctgaacagggcgggaaggcttaccggcacgccatggaggaacttcctgacacaatcgagaccctgatgctcctggcgctgatcgccgtcctcacgggaggcgttacactctttttcctgagcggcaaagggctgggaaagacctccattggcctcctgtgtgtgatggcttctagcgcccttctgtggatggcttccgtggagccccattggatcgccgccagcattatcctcgaatttttcctgatggtcctgctcattccggagcctgatcgccagagaacaccccaagacaaccagcttgcttatgtggttatcgggctgctgtttatgatcctcacagtggcggccaacgaaatgggactgcttgagaccaccaagaaggatctgggcattgggcacgtcgctgccgagaatcaccatcacgccacgatgctcgacgtggatctgcggcctgcttctgcctggaccctgtacgcggtcgccacaaccatcattacacccatgatgcgccataccatcgaaaacacgaccgctaatatttccctcacagccatcgctaaccaggccgcgattcttatgggactggacaaaggctggcctatcagcctgatggatatcggcgtgcccctcctggcccttgggtgctattctcaagttaatccgctgaccctcacagctgccgtgctgatgctggtcgctcactacgccattatcggacctggcctccaggctaaggccaccagagaggcgcagaagcggacggccgctgggattatgaaaaaccccacagtggacggaatcgttgccattgatcttgaccccgtggtctacgacgctaagttcgaaaaacagctgggccaaatcatgctgctcatcctgtgtacctcccagattcttctgatgcgcacaacctgggccctctgcgagagcatcaccctggccacagggcctctgacgaccctctgggaaggatctccgggcaagttctggaatacaaccattgcggtgagcatggctaacatctttagaggctcctatcttgccggggctggactggccttctctctgatgaaaagcctcggcgggggacggcgcggcacaggggcccagggagagaccctgggcgagaagtggaagagacagcttaatcaactgtccaaaagcgaatttaacatttacaagcggtccggcatcatggaggtggatagatctgaagctaaagaggggctcaagcgcggagaaacgacaaaacatgccgttagccggggcaccgcgaagctgagatggttcgtcgagcgcaatctggtgaagcccgaggggaaagtgatcgacctcggatgtggcagagggggatggtcctattactgcgccggccttaagaaagtcaccgaagttaagggctatacaaaagggggacctggccacgaggaacccattcctatggctacctacgggtggaacctggtgaagctgcactctggaaaagatgtgtttttcacaccccctgagaagtgtgacacgctcctgtgcgatatcggcgaaagctccccgaatcccaccattgaggaggggagaacacttcgcgtcctgaagatggtggaaccttggctccggggaaaccagttttgtatcaaaattctgaatccctatatgccttctgttgtggagaccctggaacagatgcagagaaagcatggcggcatgctcgtccgcaaccccctgagcagaaattccacacacgagatgtactgggtgagctgcgggaccggaaacatcgtttctgccgtgaacatgacgtccagaatgcttctgaatcgcttcaccatggctcatcggaaaccgacatacgagagagacgtcgatctcggcgccgggacccgccacgtggcggtggaacctgaggtcgccaacctggacattatcggacaaagaatcgaaaatattaagaacgagcacaaaagcacatggcattatgatgaagacaatccctacaagacctgggcttatcacggctcttacgaggttaagccctccgggagcgcctcttccatggtgaacggagtggtccggcttctgacaaaaccttgggatgtgatccccatggttacccagattgctatgacggacacaaccccttttggccagcaacgcgtgttcaaggagaaagtcgacaccagaacaccgcgggccaagagaggcacggctcagatcatggaagtgaccgccaaatggctctgggggtttctgagccggaataagaagccccgcatttgtacaagagaggagttcacccggaaagttcgctccaacgcggccatgggagctgtgtttgtcgatgagaatcagtggaacagcgccaaggaagctgtggaggacgagagattctgggatctggttcatcgggaacgcgagctccacaaacagggcaagtgcgccacatgcgtgtataatatgatggggaaaagagaaaagaagctgggagagttcggcaaagccaaggggtctcgggcgatctggtacatgtggcttggcgctcgctttctggagttcgaggccctcggatttatgaacgaggaccattggttcagcagagaaaattccctgtctggcgtcgagggggaaggacttcacaaactgggctatatcctccgggatattagcaagatccctgggggaaacatgtacgccgacgataccgctggctgggacacacgcattaccgaggatgacctgcaaaatgaggccaaaatcacggatattatggaacccgagcacgctctgctcgccacctccatctttaagctgacataccagaacaaagtggtcagagtgcagcggcctgcgaagtctgggaccgttatggacgtgatcagccgcagagatcagcggggctccggacaagtcggcacatatgggcttaacaccttcacgaatatggaagtgcagctgattagacagatggagtctgaaggaatctttctccccagcgagctggagacaccgaaccttgccgaacgcgtgctggactggctcgagaagcatggcgctgaacggctgaaaagaatggccatttccggggacgattgtgttgtgaagcctatcgacgatcgcttcgctaccgccctgacagcgctcaatgacatgggaaaagtccggaaggatattccccagtgggagcctagcaaaggctggaacgactggcaacaggtgcccttttgctctcaccatttccaccagctgatcatgaaggatgggagagaaatcgttgtgccttgtcgcaatcaggacaaacttgtcggccgggccagagtgtcccaaggagctggctggagcctgcgcgagaccgcctgcctcgggaaatcttacgctcagatgtggcagctgatgtattttcaccggagagatcttcgcctggccgctaacgccatttgttccgcggtccccgtggactgggttccgacgagccggaccacatggtccatccatgcccaccatcaatggatgaccacagaggatatgctctctgtgtggaataaggtctggattgaagagaacccttggatggaagacaaaacccacgtgagctcctgggaggacgttccctacctgggaaagagagaagatcagtggtgcggcagcctgatcgggctcacagctcgggccacctgggccacgaatattcaggtggctatcaaccaggtcagacgcctgattggaaatgagaactatcttgactacatgacatctatgaaacggttcaagaatgagtccgatcccgaaggcgccctgtggtga

SEQ ID NO: 18522 - RNA, 9879 nt, synthetic construct
  misc_feature 1..9879: note = derived and/or modified CDS sequence (opt5) from DENV-1__JQ922546__SS-prME
  source 1..9879: mol_type = other RNA
agcgtggccatgctgctcatgctgcttcccaccgctctggccttccacctcaccacgagaggcggggagcctcatatgatcgtctccaagcaggaacggggaaaatctctgctttttaagaccagcgcgggcgttaatatgtgcaccctgattgctatggacctcggggagctgtgtgaagataccatgacatacaaatggccgcgcatcaccgaggccgaacccgacgatgtggactgctggtgtaatgccacagatacctgggtgacgtatggaacctgctcccaaacaggcgagcacagacgggacaagcgctctgtcgctctggcccctcatgtggggctcggactggagaccagaacagaaacctggatgagctccgagggcgcttggaaacagattcagaaggttgaaacgtgggcccttcggcaccccggcttcacagtgatcgcgctgtttctcgcccatgctattgggacctctatcacacagaagggaatcattttcatcctgcttatgctggtcacccctagcatggccatgcgctgtgtgggcattgggaacagagattttgttgagggactctccggcgctacctgggtggacgtcgtgctggagcacgggagctgcgtgacaacgatggccaaaaataagcccaccctggatatcgaactcctgaaaacagaggtcaccaaccctgcggttcttcggaagctgtgtattgaagccaaaatctctaatacaaccacggactcccgctgcccgacacaaggagaggctaccctcgtggaggaacaggatgccaacttcgtgtgtagacggacctttgtcgaccgcggctggggcaatgggtgcggactgttcggcaaggggagccttctgacatgtgctaagtttaaatgcgtgaccaagctcgagggaaaaattgttcagtacgaaaacctgaagtattctgtgatcgtcacagtgcacacgggcgatcagcatcaagttgggaatgagaccacagaacacggaaccatcgccattatcacaccccaggcccctacctccgagattcagctgacggactacggcgctctcaccctggactgcagccccagaacaggccttgatttcaacgaaatggtgctgctcaccatgaaagagaagtcttggctggtccataaacagtggtttcttgacctgcctctcccctggacatccggggcgagcacctcccaagagacgtggaatcggcaggatctgctggtgacattcaagaccgcccacgctaagaaacaggaagtcgtggttctcggatctcaagagggcgccatgcacacagccctgaccggggctaccgaaatccagacaagcggaacgaccacaatttttgccggccatcttaagtgtcgcctgaaaatggacaagctcaccctgaaagggatgtcctatgtgatgtgcacaggcagcttcaagctggagaaggaagtcgcggagacccagcacggaacggtgcttgttcaggtgaaatacgagggcacagatgctccgtgtaagatccctttctctatccaagacgaaaaaggggtcacccagaacggaagactcattaccgccaatcccatcgtgacagataaggagaaacctgtgaacattgaaaccgagccgccctttggcgagtcctatatcgttgtcggggccggagaaaaggctctgaagctgagctggttcaaaaagggctctagcattgggaaaatgtttgaggccacagctcggggcgccagacgcatggcgatcctcggagacacggcctgggatttcggctccatcgggggagtgtttacctctgtgggcaagctggtccatcaggtgttcgggacagcttacggagttctttttagcggcgtgtcctggaccatgaaaattgggatcggcattctgctcacatggctgggactgaatagccggtctacctcccttagcatgacgtgcatcgccgtcggcatggtgaccctctacctgggggttatggtgcaggctgactctggatgtgtcattaactggaagggcagagaactgaagtgcgggtccggaatcttcgtgacaaacgaggttcacacctggacagaacaatataaatttcaggccgatagccctaagcgcctctccgcggccattggcaaggcttgggaggagggggtgtgtggcatccggtctgccaccagactggaaaatgtcatgtggaagcagatcagcaacgagcttaatcatattctgctcgaaaacgacatgaaattcacagtggtggtcggagacgttaatggcatcctggctcaggggaagaaaatgattcgcccgcaacccatggagcacaagtactcctggaagtcttggggaaaagccaagatcattggcgccgatatccagaacaccacgtttatcattgacgggcctgatacacccgaatgccctgacgatcagcgggcttggaatatctgggaggtggaggactatggattcggcatttttaccaccaacatctggctgaaacttagagatagctacacacaggtgtgtgaccaccgcctcatgtccgcggccattaaggatagcaaagctgtccatgccgacatgggctattggatcgaatctgagaagaatgaaacctggaagctggcccgggcttccttcatcgaggtgaaaacgtgcacatggcccaagagccacaccctgtggtctaacggggttctcgaatccgagatgattatcccgaaaatttacggaggccctatcagccaacataattatagacccgggtacttcacacagaccgccggaccttggcacctgggcaaacttgagctggattttgacctctgtgaagggacaaccgtggtcgtggatgagcactgcggaaaccgcggcccctctctgcggacgaccacagttaccggcaaaattatccatgaatggtgctgtagaagctgcacactgcctccccttcggttcaagggggaggacggatgttggtacggcatggagatccgcccggtgaaggaaaaagaggaaaatctcgtcagatccatggtgagcgcggggtctggagaggttgactcctttagcctgggcctgctctgcgtgtccattatgatcgaagaggtcatgcggtctagatggagccgcaagatgctgatgaccgggacgcttgctgtgttctttctgctcattatgggacagctgacatggaacgatctgttccggctttgtatcatggtgggcgccaatgcctccgacagaatgggcatggggaccacatatctggctctcatggccacctttaaaatgcgccctatgttcgcggtcggactgctctttagacggctgacctctcgcgaggttcttctgctcacaattggcctgagcctggtggcttccgtggaacttcccaactctctggaggaactcggggatggactggccatgggcatcatgatgctcaagctgcttacggacttccaaagccaccagctgtggaccacactcctgtccctgacctttattaaaacaacccttagcctggattacgcctggaagacgatggctatggtcctctctatcgtgtccctgagccccctctgcctgtctacaacctcccagaagaccacatggcttcctgttctgctggggagcttcggatgtaaaccgctcaccatgtttctgatcacagagaacaagatttggggcagaaaatcttggccccttaatgaaggcatcatggccgtggggattgtctccatcctgctcagctccctgctcaagaacgacgtgcctctggctggaccccttattgccggcgggatgctgatcgcgtgctatgttatcagcggatctagcgccgatctgtccctcgagaaagctgccgaggtgtcttgggaagaggaagctgagcatagcggcgcctcccacaatattctggtcgaagtgcaggacgatgggacgatgaagatcaaagacgaggagcgggatgacacccttacaattctgctcaaggcctctctgctcgctgtcagcggagtgtaccctatgtccatccccgcgaccctgttcgtttggtatttctggcaaaagaaaaagcagcgctctggcgtgctttgggatacacctagccctcccgaagtcgagagagccgtgctggacgacggcatttaccggatcctgcagcgcgggctcctgggaagatcccaggttggcgtggggatctttcaagatggagtcttccataccatgtggcacgtgacgcggggcgctgtgcttatgtatcaggggaaacgcctggaacccagctgggcctctgttaagaaagacctcatttcctacggaggcggctggagatttcaggggagctggaacaccggagaggaggtccaggtgatcgccgtggaacccggcaagaatcctaagaacgtccaaacaacccccgggattttcaaaacaccggagggagaagtgggcgctatcaccctggattttaagcctgggacatctggatcccccattgttaatcgggagggcaaaatcgtgggcctctacgggaacggagtcgtgacgaccagcggcacatatgtttccgccattgcgcaggctaaggcctctcaggaagggcctctgcccgagatcgaggacgaagtgttcagaaaacgcaatcttaccatcatggatctgcaccccggaagcggcaagacccggagatacctgcctgccattgtccgcgaggctatgaagcggaaactcagaacactgatccttgccccgacgcgcgtggttgcgtccgaaatggctgaggccctgaaggggatgcccattcggtatcaaaccacagccgtgaaaagcgaacataccggcagagagatcgtcgacctcatgtgtcacgctacatttaccatgcgcctgctgtctcctgtgcgggtgcccaactacaatatgattatcatggatgaggcccatttcacggaccctgcttccatcgccgcgagaggatatattagcacacgggtcggcatgggggaagccgctgccatctttatgaccgctacaccccctggatctgttgaggccttcccgcagagcaacgccgtgattcaggatgaagaacgcgacatccccgaaagatcctggaactctggctacgattggattacagactttcctgggaagaccgtgtggttcgtccccagcatcaaatccggaaacgacatcgctaattgcctccggaagaacggcaagcgcgtgattcagctttctagaaaaacattcgataccgagtatcaaaagacgaaaaacaatgactgggattacgttgtgacaaccgacatcagcgagatgggggcgaactttcgggccgatagagtcattgaccctcgccggtgtctgaagcccgtgatcctgaaagaaggcccggagagagttattctcgctggacctatgcccgtgacagtcgcctccgccgctcagcgccggggcagaatcgggcgcaatcagaacaaggaaggagatcagtacgtgtatatgggccaacccctgaataacgacgaggatcacgcccattggaccgaggcgaagatgcttctggaccacattaatacgcctgaagggatcatccccgctctcttcgagcctgaacgggagaaaagcgccgccattgatggagaatacagactgcgcggcgaggctagaaagacctttgtcgagctgatgcggcgcggggacctcccggtgtggctttcttataaagttgcctccgaaggcttccagtacacagatagacggtggtgctttgacggagagcgcaacaatcaggtgctggaagagaacatggacgtggaaatctggatggaggagggcgaaaagaaaaagattagaccccggtggctggagatcgaaaaatatagcgatcctctcgcgctgagagagttcaaggaattttccgccaagcgcaaatctgtccttggggacctgaagctcgagattggaaaactgccccagcacctgaccatcaaggctcggaatgccctcgataaccttgttatgctgcataatagcgagcaaggcgggaaggcttacagacacgccatggaggaactgcctgacacaatcgaaaccctcatgcgcctgggacttattgctgtgatgacaggcggcgtgaccctgttctttctctccgggaagggactgggcaagacgtctaacgggctgctctgcgtcatggccagctccgtgcttctgtggatggcgagcgttgagccccattggatcgccgcttctattatcctggagttctttctcatggtgctgcttattccggaacctgatcggcagagaacaccccaggacaatcagctggcctatgtcgtgatcggactcctgttcatgatcctgaccgtcgctgccaacgagatgggcctccttgaaaccaccaagaaggatctggggattggacacgtggttgccgagaaccaccatcacgctaccatgctggacgtggatctccatcctgcgtccgcctggacactgtacgctgtcgccacgaccatcattacacccatgatgcggcacaccatcgaaaatacaaccgccaacattagccttacggctatcgccaatcaagcggccattctgatgggcctcgacaaaggctggcctatctctaagatggatatcggggtgcccctgctggctctcggatgttactcccaggttaacccgcttaccctgacagccgctgtgctgatgctcgtcgcccattatgcgattatcggccctgggctgcaggccaaagctacccgcgaggcccaaaagagaacagctccccagattatgaagaatcagatcgtggacggaattgtggccgttgatcttgaccccgtcgtgtacgacgctaaatttgagaagcagctgggccaaatcatgctcctgatcctgtgcaccagccagattctccttatgcggacgacatgggccctgtgtgaatctatcaccctggcgacagggcctctcaccaccctgtgggagggaagcccgggcaaattctggaacacaacgattgccgtgtccatggctaatatcttccgcggctcttatcttgccggggctggactggcctttagcctcatgaagtccctgggcgggggaagacggggcaccggggcccagggagaaacactgggcgagaaatggaagcgccagctcaaccaacttagcaagtccgagttcaatacctacaaaagatctggcattatggaggtcgatcggagcgaggcgaaggaagggctgaaacgcggagagacaaccaagcacgctgtttccagaggcacggccaaactgcggtggtttgtggaaagaaacctcgtgaagcccgaggggaaagtcatcgacctgggatgcggccgcgggggatggtcttattactgtgctggccttaagaaggtgacagaagttaaaggctataccaaagggggacctggccacgaggagcccatccctatggccacctacgggtggaatctggtgaaactccatagcggaaaggatgtcttctttacaccccctgaaaaatgcgacaccctgctgtgtgatattggcgagtcctctccgaaccccacaatcgaagaggggcggacgctcagagtgcttaagatggttgagccttggctgcgcggaaatcagttctgcattaagatcctgaacccctacatgcctagcgtggtcgaaaccctcgagcagatgcagcggaaacacggcggcatgctggtgagaaatcccctttcccgcaacagcacacatgaaatgtattgggtgtcttgtgggaccggaaatattgtctccgccgttaacatgacaagccggatgctgctcaacagatttaccatggctcaccgcaagccgacgtacgagcgggacgtggatctgggcgccgggaccagacacgtggcggtcgaacctgaggtggccaatctggacatcattggacaacgcatcgagaacatcaaaaatgaacataagtctacatggcactatgatgaggacaacccctacaaaacctgggcttatcatggctcctacgaagttaagcccagcgggtctgcctccagcatggtgaatggagtcgtgcggctcctgacaaagccttgggatgttattcccaccgtgacacagatcgctatgaccgacacgacacctttcggccagcaaagagtctttaaagagaaggtggacacccgcaccccgaaagccaagagaggcacagcgcagattatggaagttacggccaactggctttgggggttcctgtcccggaataaaaagccccgcatctgcaccagagaggagtttacacggaaggtgagaagcaacgctgccattggagctgtcttcgtggatgaaaatcagtggaactctgccaaagaggctgtcgaagacgagcggttttgggatctcgtgcaccgcgaaagagagctgcataagcagggcaaatgtgcgacctgcgtttataatatgatggggaagcgggagaagaaacttggagagttcggcaaagccaaagggagccgcgccatctggtacatgtggctgggcgctagattcctcgagtttgaagccctgggattcatgaacgaggaccactggttttcccgggaaaattctctgagcggcgtggaaggggagggactccacaagctgggctacatccttcgcgatatttccaaaatccctgggggaaacatgtatgctgacgatacagccggctgggacaccagaattacagaagatgacctgcaaaatgaggccaagatcaccgatattatggaacccgagcatgcgctcctggctacgtctatcttcaaacttacctaccagaacaaggtcgtgcgggtgcagcgccctgccaaaagcgggacagttatggacgtgatctccagacgggatcagcgcggctctggacaagtcggcacctatgggctgaacacatttaccaatatggaggtgcagctcattagacagatggaaagcgagggaatcttcctgccctccgaactggagacgccgaacctcgccgaacgggttctgaattggcttgagaagcacggcgtggagcgcctgaagagaatggctattagcggggacgactgcgtcgtgaaacctacagatgaccggtttgccaccgctctcacagccctgaacgatatgggaaaggtcagaaaagacacaccccagtgggaaccttctaagggctggaatgattggcaacaggtgcccttctgttcccatcactttcaccagcttatcatgaaagacgggcgcgagattgttgtgccttgccggaaccaggatgaactggtcggcagagcgcgcgtgagccatggagccggctggtctctccgggagacggcttgtctggggaagtcctacgcccaaatgtggcagctgatgtatttccacagacgcgacctccggctggctgccaatgcgatctgcagcgccgttcccgtggattgggtcccgacctccagaacaacctggtctatccatgctcaccatcagtggatgacaaccgaagacatgcttagcgtgtggaaccgcgtgtggattgaggagaatccttggatggaagataagacacacgtttccagctgggaggacgtcccctacctgggaaaacgggaagaccaatggtgtggctctatcattgggctcaccgccagagctacgtgggccacaaacatccaggtggctattaatcaggtgcgccggctgatcggaaacgagaattatcttgattacatgacctccatgaagagatttaaaaacgagagcgaccccgaaggcgccctgtggtga

SEQ ID NO: 18523 - RNA, 9879 nt, synthetic construct
  misc_feature 1..9879: note = derived and/or modified CDS sequence (opt5) from DENV-1__JQ922545__SS-prME
  source 1..9879: mol_type = other RNA
agcgtgaccatgctgctcatgctgcttcccaccgctctggctttccacctcacgaccagaggaggggagcctcatatgatcgtctccaagcaggaacggggaaaatctctgctttttaagaccagcgccggagttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatacaattgggacctctatcacccagaagggaatcattttcatcctgcttatgacaggcgcccctattatggctatgagatgcgtcgggatcggaaaccgggattttgtggagggcctgagcggggccccctgggttgacgtggtcctcgagcacggatcctgtctgagcaatatggctaagaacaaacctacgctggatattgacttctttaagaccgaagtgacaaatccggccgtgctccgcaaactgtgcatcgaggcgaagatttctaacaccacaaccgattccagatgtcccacgcaaggcgaagccacacttgtcgaggaacaggacgctaatttcgtttgccggcgcacctttgtggatagaggctgggggaacggatgtggcctgttcgggaaaggaagcctcctgacctgcgccaagtttaagtgcgtgacaaaacttgagggcaagatcgtccagtacgagaatctgaaatattctgtgatcgttaccgtgcacacaggggaccagcatcaagtcggaaacgaaacgaccgagcacggcacaattgctaccatcacacctcaggcccccacctccgaaattcagctcacggactacggcgccctgaccctggattgtagccctcggacagggctcgacttcaatgagatggtgctgcttaccatgaaggaaaaatcttggctggttcataagcagtggtttctcgatctgccccttccgtggacatccggagctagcacctcccaagagacgtggaaccgccaggacctgctcgtgacattcaaaaccgcgcacgccaagaagcaggaggtcgtggtcctgggctctcaagaaggggctatgcacacagccctgaccggagccaccgagatccagatgagcggcacaacgaccattttcgctgggcatctcaaatgcagactgaagatggataaacttacactgaagggcgtgtcctatgttatgtgtaccggcagctttaaactcgaaaaggaggtggccgaaacacagcacggcaccgtcctggtgcaggttaagtacgaggggacggacgcgccttgcaaaatccccttctctacacaagatgagaagggagtgacccagaatggccggctgatcaccgctaaccctattgtcacagacaaagaaaagcccgtgaatatcgagaccgaacccccttttggggagtcctatattgtgatcggagccggcgagaaagcccttaagctcagctggttcaagaaagggtctagcattggcaagatgtttgaagctacagccagaggagctcgccggatggccatcctgggcgatacggcgtgggacttcgggtccatcggaggcgtttttacctctgtcgggaaactggtgcatcaggtgttcggaacagcctacggcgtcctctttagcggggtgtcctggaccatgaagattggcatcggcattctccttacatggctgggactcaacagcagatctacctccctgagcatgacgtgtatcgctgttgggatggtgaccctgtaccttggagtcatggtgcaggccgattctggctgcgttattaactggaaagggcgcgagctcaagtgtggatccggcatcttcgtgacaaatgaagtccacacctggacagagcaatataagtttcaggctgacagcccgaaacggctgtccgccgcgattgggaaggcctgggaagagggcgtgtgcggaatcagatctgctacctgtctggagaacatcatgtggaaacagattagcaatgaactcaaccatatcctgcttgagaatgacatgaagttcacagttgtggtcggcgatgccaacgggattctgacccagggcaagaagatgatccgcccccaacctatggaacacaaatactcctggaagtcttggggcaaggctaaaattatcggggccgacatccagaatacgacatttattatcgatggacccgacacccctgagtgccccgatgaccagcgggcctggaacatttgggaagtggaggattatggcttcggcatcttcaccacaaatatttggctcaagctgagagacagctacacccagatgtgtgatcaccgcctgatgtccgctgcgatcaaagacagcaaggccgtgcatgctgatatggggtattggatcgagtctgagaaaaacgagacgtggaaacttgcccgggcctcctttattgaagtcaagacatgcatctggccgagaagccacaccctctggtctaatggagttctggagtccgaaatgattatccctaaaatttacggcgggcccatcagccaacataactatcgccctggatacttcacacagaccgctggcccctggcacctggggaagctcgagctggactttgatctttgcgagggaacaaccgtggtggtcgacgaacactgtggcaatcggggcccttctctgagaacgaccacagtgaccgggaaaatcattcatgagtggtgctgtcggagctgcacactgcccccgctgcgcttcaagggagaagacggctgttggtacgggatggagatcagacctgttaaagagaaggaagagaacctggtgcggtccatggtcagcgccggatctggcgaagtggattcctttagccttgggctcctgtgcgtttccattatgatcgaggaagtgatgagatctcgctggagccggaagatgctgatgaccggaacgctcgcggtcttctttctgcttattatgggccagctgacatggaatgacctcatcagactgtgtattatggtgggcgctaacgtttccgatcgcatggggatgggaaccacatatctggcccttatggccaccttcaaaatgagacccatgtttgctgtgggcctcctgttccggcgcctgacctctagagaggtcctcctgcttacaatcgggctgagcctcgtggcctccgtggagctgcccaactctctggaagaacttggagacggcctggcgatggggatcatgatgctcaagctgctcacggattttcaaagccaccagctgtggaccacacttctgtccctcaccttcattaaaacaaccctgagcctggactacgcttggaagacgatcgccatggtcctttctattgtttccctgtttcctctctgcctgagcacaacctctcagaaaaccacatggctcccggtgctgcttggatccttcggctgtaagcccctgaccatgttcctgatcacagaaaataagatttggggccggaaaagctggcctctcaacgaggggatcatggccgtgggaatcgtctctattctgctttccagcctgctcaagaatgatgtgcccctggctggccctctcatcgccgggggaatgctgattgcttgctatgttatctccggcagctctgccgaccttagcctggaaaaagcggccgaggtgtcctgggaggaagaggctcagcattctggggccagccacaacattctggtcgaagtgcaagatgacggaacgatgaagatcaaagatgaggaacgcgacgataccctcacaatcctgcttaaggctaccctgctcgccgtttccggcgtgtaccccatgtctattcctgccacactgtttgtctggtatttctggcagaaaaagaagcagagaagcggcgtgctctgggacaccccctccccgcctgaggtcgagcgggctgtgctggacgatgggatctaccgcattcttcagagaggactgctgggccggtctcaagttggggtgggagtctttcaggacggcgtgttccatacgatgtggcacgttacccgcggggcggtgctcatgtatcagggaaaaagactggaacccagctgggcctccgtcaagaaagatcttatcagctacggcggcgggtggcggtttcagggatcttggaatacaggcgaggaagtgcaagtgattgctgttgagcctgggaagaaccccaaaaatgtccagaccacaccgggaaccttcaagacacctgagggcgaagtgggggccatcgccctggactttaagcccggaacgtccggcagccctattgtgaacagagagggcaaaatcgtcgggctctacggaaatggcgtggttaccacatctgggacctatgtgtccgctatcgcccaggcgaaggctagccaagaaggacccctgcccgagattgaagatgaggtcttcaaaaagcgcaacctcaccatcatggacctgcaccctggctccgggaaaacacggagataccttccggccattgtgcgcgaggccatcaagcggaagctgagaacgctgattctcgctcccacccgcgttgtggcctctgaaatggcggaggctctgaaaggcatgcctatccggtatcagacaaccgccgtcaagagcgaacatacaggaagagagatcgtggatcttatgtgtcacgccacctttacgatgcgcctgctctcccccgttcgggtgcctaattacaacatgattatcatggacgaagctcatttcacagatcccgccagcattgctgccagaggctatatctctacccgggtcgggatgggagaggcggccgctatttttatgaccgccacacctccgggctccgtggaggctttcccccagagcaatgccgtgatccaggacgaagaacgcgatatccctgaaagatcttggaacagcgggtacgactggattaccgacttccccggaaaaacagtctggtttgttccttccatcaagtctggcagcgatattgccaccgtgctggagcggtcccgcgaacccgtgatccaactgtctagaaaaacgttcgacacagagtatcagaagaccaagaataacgattgggactacgtcgtgacaaccgatattagcgagatgggggctaactttcgggcggacagagttatcgatccgcgccggtgcctcaaacctgtgattcccaaggacggccccgaaagagtcatccttgccggacctatgcccgtgacggttgcttccgccgcccagcgccggggcagaatcgggcgcaatcagaacaaagagggagatcaatacatttatatgggccagcctctgaataacgacgaagatcacgctcattggaccgaggccaagatgctgctcgacaatatcaacacaccggaggggattatccccgcgctgttcgaacctgagcgggagaaaagcgctgccattgatggagagtacagacttcgcggcgaagccagaaagacctttgtggagctgatgcggcgcggggacctccccgtctggctgtcttataaggtggcttccgagggcttccagtacagcgacagacggtggtgctttgatggagaacgcaataaccaggtcctggaggaaaatatggacgtggagatctggacaaaagaaggcgagagaaagaaactccggcctagatggcttgatgcccgcacctattccgaccccctggcgctgcgggagttcaaggaatttgccgctgggagacgctctgttagcggagatctcatcctggagattgaaaaacttccgcaacacctgacactccgggcccagaacgctctggacaatctggtgatgctccacaactccgagcagggcgggaaggcctacagacatgctatggaggaacttcctgataccatcgagacgctgatgctgctcgccctgattgcggtgcttacaggaggcgtcaccctgttctttctctctggcaaagggctgggaaagaccagcatcggcctgctctgtgttatggcctccagcgtgcttctgtggatggcttctgtggaaccccactggattgccgcttccatcatcctggagttcattctcatggtcctgcttatccctgaacccgaccggcagcgcacacctcaagataatcagctggcctatgtggttattgggctcctgtttatgatcctgaccgtggccgctaacgagatgggactccttgagacaacgaagaaagacctgggcattgggcatgtcgtggcggaaaatcaccaccatgccaccatgctggatatcgacctccaccccgctagcgcctggacactgtacgccgtcgctaccacaattatcaccccgatgatgagacatacgatcgagaacaccacagccaacatttctcttaccgcgatcgccaatcaggctgccattctgatgggactcgataagggctggcctatctccaaaatggacattggcgtgcccctgctggctctcgggtgctacagccaagttaacccccttacactgaccgccgcggtgctgatgctcgtcgcccactatgctatcatcggacctggcctgcaggccaaggctacgcgggaagcccagaaacgcacagctgccgggattatgaagaatccgaccgtggacggaatcgttgcgattgatcttgaccccgtggtctacgatgccaagttcgagaaacagctgggccaaatcatgctcctgattctgtgtacatctcagatcctccttatgagaaccacctgggctctgtgcgaaagcatcacactggccacggggcctctcaccacactgtgggagggatcccccggcaagttctggaacaccacaattgctgtgtctatggccaatatctttcggggcagctatcttgccggggcgggactggctttctccctcatgaaaagcctgggcgggggacgcagaggcaccggggcccagggagagacgctgggcgaaaagtggaaacggcagctcaaccaactttccaagtctgagtttaatacatacaagcgcagcggcattatggaagtggacagatccgaggctaaagaagggctgaagcggggagagaccaccaaacatgccgtttctagaggcacagccaagctgcgctggttcgtcgagcggaacctcgtgaaacctgaagggaaggtgatcgatctgggatgtggcagagggggatggagctattactgcgctggccttaagaaagtcaccgaggttaagggctatacaaaagggggacccggccacgaggaacctattccgatggccacgtacgggtggaatctggtgaagctccactccggaaaagacgtgtttttcacaccccctgaaaagtgtgatacactgctgtgcgacatcggcgagtctagccccaaccctaccattgaggaagggcgcacactccgggtccttaaaatggtggagccctggctgagaggaaatcagttttgtatcaagatcctgaacccgtacatgccttccgttgtggaaaccctcgagcagatgcagcgcaagcatggcggcatgctggtccggaatccccttagcagaaactctacgcacgagatgtattgggtgtcctgcgggaccggaaatattgttagcgcggtgaacatgacatctcgcatgctgctcaatcggttcaccatggcccatagaaaacccacatacgaacgcgatgtcgacctgggcgctgggacccggcacgtggccgtggagcctgaaatcgctaacctggatattatcggacaaagaattgagaacatcaagatcggccacaaatccacatggcattatgacgaagacaatccctacaagacctgggcctatcacgggagctacgaggtcaaaccttctggatccgcgagctccatggttaacggcgtggtgcgcctcctgacgaagccgtgggatgtcattcccatggtgacacagatcgccatgaccgacaccacaccttttggccagcaaagagttttcaaggagaaagtggatacgcggacaccccgccctaagagagggacagctcagattatggaagtcaccgccaaatggatgtggggatttcttttccggaatagacccccgcggatctgtacacgcgacgagtttgctagaaaggtgcggagctctaccgccaacggcgctgttttcgtggatgaaaatcagtggaacagcgccaaagaggcggtcgaagacgagcgcttctgggatctggtgcatagagagcgggaactccacaagcaggggaagtgcgccacatgcgtttataatatgatgggaaaacgcgagaagaaactgggcgaatttgggaaggctaaaggctccagagccatttggtacatgtggcttggagctcggttcctggagtttgaagccctcggcttcatgaacgaggaccattggttttctcgcgagaatagcctgtccggggtggaaggagagggcctgcacaagctcgggtacatcctgagagatatctctaagattcctggaggcaacatgtatgccgacgataccgcggggtgggacacgcggatcaccgaagatgacagctccaatgaggctaaaattatcgagcttatgcgccccgaacacgccctgctcgccacatctattttcaagctgacctttcaaatcagcgtcgtgagagtccagcggcctgctaaatccggcacagtgatggagtgtatcagccgcagagaccagaagcggtctggacaggttggcacctacgggcttaacacgttcacaaatatggaagtgcaactgattagacagatggagtccgaaggaatctttagcccctctgagatggagaactccaatctcgccgaacgcgtcctggattggctggagaaacatggcgtggaacggctcaagagaatggctattagcggggacgattgcgtggttaaacctaccgacgatcgcttcgccacagcgctgaccgcccttaacgacatgggaaaggtgcggaaggatatcccccagtgggagccgtccaaaggctggaacgactggcagcaagtccctttttgttctcaccatttccaccagctgattatgaaggatgggagagaaatcgtggttccctgccgcaatcaggacgagctcgtgggccgggctagagtcagccagggagccggctggtccctgcgcgagacggcttgtcttgggaaaagctatgcccaaatgtggcagctgatgtactttcaccggagagatctccgcctggcggccaacgctatttgctctgccgtgcccgtcgactgggtgcctacctcccggacaacctggagcatccatgctcaccatcagtggatgacaaccgaagacatgctgtctgtttggaatagagtgtggatcgaggaaaacccgtggatggaggataagacacacgtcagctcctgggaagacgtgccctatctcggaaaacgggaggatcaatggtgtggctctctgattgggcttaccgccagagctacgtgggccacaaatatccaggttgcgattaaccaggtgcgccggctgatcggaaatgagaactacctcgactatatgaccagcatgaagagattcaagaatgaatccgatcctgagggcgccctgtggtga

SEQ ID NO: 18524 - RNA, 9879 nt, synthetic construct
  misc_feature 1..9879: note = derived and/or modified CDS sequence (opt5) from DENV-1__GU131887__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagagcaggacgctaacttcgtgtgccggcgcacatttgtggatagaggctggggcaatgggtgtggactcttcggcaaagggtctctgatcacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatccggtacgagggcacagacgcgccgtgcaagatccctttctccacccaagatgaaagaggggttacacagaacggacgcctgattacggctaatcccatcgtgaccgacaaagagaagcctgtcaacattgaagccgagcccccctttggcgagagctatatcgtgattggggccggagaaaaagctcttaagctctcttggttcaaaaagggcagctccatcgggaagatgtttgaggccacagctcggggcgccagacgcatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctcggtccacaagcttctctatgacctgtattgccgtgggcctggttacactgtaccttggggtgatggtccaggctgattccggatgcgtgatcaactggaaaggcagagaactcaagtgtgggagcggaatttttgttaccaatgaggtgcacacatggaccgaacaatataaattccaggccgactcccctaagcgcctgtctgcggccatcggcaaggcttgggaggagggggtctgcggcatccggagcgccacgagactggaaaacattatgtggaaacagatctccaacgagctcaatcatattctgcttgaaaacgacatgaagtttacagtggttgtgggagatgtcgctggcatcctggcccaggggaaaaagatgattcgcccgcaacccatggagtacaaatattcttggcggagctggggaaaggccaaaatcatcggcgctgacgtgcagaataccaccttcattatcgatgggcctaacacacccgaatgtcctgacgatcagagagcgtggaatatttgggaggtggaggactacggatttggcatcttcaccacgaacatttggctcaagctgcgcgattcctatacacaggtctgcgaccaccggctgatgagcgccgctatcaaggattctaaagccgttcacgccgacatgggctactggatcgaatccgagaagaatgaaacctggaaacttgctagagccagcttcattgaggtgaagacatgtatctggcccaaatctcataccctctggtccaacggggtgctggaaagcgagatgattatcccgaagatttatggaggccctatctctcaacacaattaccggcccgggtactttacacagaccgcgggaccttggcatctgggcaagctcgagctggatttcgacctttgcgaagggacgaccgtcgtggttgatgagcactgcggaaaccgcggccccagcctgagaacaaccacagtgaccggcaaaatcattcacgaatggtgttgccggtcctgtacgctccctcccctgagatttcgcggggaggacggatgctggtatggcatggagatccggccggtcaaggaaaaagaggaaaatctggtgaagagcatggtttctgctgggtccggagaggtggacagcttctcccttggcctcctgtgtatttctatcatgattgaagaggtcatgagaagccgctggtccagaaaaatgctgatgacagggaccctcgccgtgtttctgcttctgatcatgggacagctcacatggaacgatctgattcggctgtgcatcatggttggcgccaatgcttctgaccgcatgggcatggggaccacctaccttgccctgatggcgacattcaagatgagacctatgtttgctgtgggactcctgttccggcgcctcacgagcagagaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataaaatctggggccggcgctcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagagagacgataccctgacaattcttctgaaagccaccctcctggctgtttctggagtgtatcctctcagcatccccgccacactgttcgtctggtacttctggcaaaagaaaaagcagcggtccggcgtgctttgggacaccccttctcccccggaagtcgagcgcgccgtgctggatgacggcatttatagaatcatgcagcgggggctgctcggaagaagccaggttggcgtgggggtctttcaagaaaacgtgttccatacgatgtggcacgttacccgcggagctgtgctgatgtaccagggcaaacggcttgagccttcctgggccagcgtcaagaaggacctgatttcttacgggggaggctggagactccagggctcctggaatacaggggaggaagtgcaggtgatcgcggttgagcccggaaaaaaccctaagaatgtccaaaccgctcccggcacatttaaaaccccggaaggggaggtgggagccattgccctggatttcaagcctggcacaagcgggtctcccatcgtgaaccgcgaaggaaaaatcgtcggcctctatggcaatggggtggttacgacctccggaacatacgtgagcgctattgcccaggcgaaggcttcccaggagggccctctgcccgagatcgaagacgaggtctttcggaagagaaaccttaccattatggatctgcaccccgggtctggaaaaacccgccggtatctgcctgccatcgtgagagaagccattaagcgcaaactccggacactgatccttgctccgacgagagttgtggccagcgagatggctgaagccctgaagggcatgcccatccggtaccaaaccacagcggtcaaatccgagcataccgggaaggagattgtggacctcatgtgccacgccacattcaccatgcgcctgctgagccctgttagagtgcccaattataacatgatcattatggatgaagctcattttacggacccttcttccatcgccgctcggggctacattagcacacgcgtcggaatgggcgaggccgccgctatcttcatgaccgcgaccccccctgggtctgtggaagcctttccgcagagcaatgctgtgatccaggatgaggaaagagacattcccgagcggtcctggaactctggatatgagtggatcacagatttccctggcaagaccgtctggtttgttcccagcattaaatccgggaatgacatcgccaactgtctcagaaagaatggaaaacgcgtgattcagctttctcggaagacattcgataccgaataccaaaaaacgaagaacaacgactgggactacgtggtcacaaccgatatcagcgagatgggcgccaatttcagagctgaccgcgtgattgatcctcggagatgcctgaagcccgttatcctgaaagacgggccggaacgcgtgatcctcgccggccctatgcccgtcacagtggcgtccgctgcccagcggagaggacgcattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgggaaaagagcgcggccatcgatggggagtatcgcctgagaggagaggctcggaaaaccttcgttgaactgatgcgcagaggcgacctcccggtgtggctttcttacaaggtcgcctccgaggggtttcaatatagcgatcggagatggtgcttcgacggcgaacgcaacaatcaggtgctggaggaaaacatggatgtcgagatctggacaaaggagggagaacggaaaaagctgagaccccgctggctcgacgctcggacctactccgaccctctggcccttagagagtttaaagaattcgctgccggccggcgctctgtgagcggggatctgattctcgagatcggaaagctgccccagcacctgacacagagagcgcaaaatgccctcgacaaccttgttatgctgcataattccgaacagggcgggcgggcttatcgccacgccatggaggagctgcctgataccattgaaacactcatgctgcttgctctgatcgccgccctcaccggaggcgtgacgctgtttttcctgtctggcagagggctcggaaaaacaagcattggccttctgtgtgtgatggcttccagcgtcctgctctggatggcgtctgttgagccccattggatcgccgcttccatcattctggaatttttccttatggtgctgctcatcccggagcctgaccggcagcgcaccccccaggataaccaactggcctacgtggtcattgggctgctctttatgatccttaccgtggccgctaatgagatgggactgctggaaacaaccaagaaagacctcggcattgggcacgttgccgtgggaaaccaccatcacgcggccatgctggatgtcgaccttcatcctgctagcgcctggacactgtacgctgtggccacgaccatcattacacccatgatgagacacaccatcgagaacacaaccgcgaatatctctctcacggccattgctaaccaggccgctatcctgatgggcctggataagggctggcctatttccaagatggacatcggggtccccctccttgccctgggatgctatagccaggtgaatccgctgaccctcacagctgccgttctgatgcttgtggcgcattacgccattatcggccctgggctgcaagctaaagccacccgggaagctcagaagcgcacagccgccggaatcatgaaaaaccccaccgtcgatggcattgtggcgatcgacctcgatcccgttgtgtatgacgctaagttcgagaaacagctggggcagattatgctgctcatcctttgtacgtctcaaattctgctgatgagaacaacctgggccctctgcgaaagcatcacactggctaccggacctcttaccacactgtgggagggctccccgggcaagttttggaatacgaccatcgccgtctctatggccaacattttccgggggagctacctcgctggagccggcctggcgttctccctgatgaagagcctcgggggaggcagacgcgggacaggagcccagggcgagacccttggcgaaaaatggaagcggcagctgaatcagctgtccaaatctgagtttaacacatataagagaagcgggatcatggaagtggaccgctccgaggctaaagaaggactcaagcggggcgagattaccaagcacgccgtgtctagagggacggctaaactgcgctggttcgttgagcggaatcttgtcaagcccgaaggaaaagtgatcgatctgggctgtgggagaggaggctggagctactattgcgccggcctcaagaaagtgacagaggtcaaggggtacaccaagggaggccctgggcacgaagagcccattcctatggcgacctacggatggaacctggttaaactgcattccggcaaggacgtgtttttcgtgccccctgaaaaatgtgatacactcctttgcgacatcggggagtctagcccgaatcccaccattgaggaaggacgcacactgcgggtcctgaagatggtggagccttggctcagaggcaaccaattttgtatcaaaatcctgaatccctatatgccttccgttgtggaaacgcttgagcagatgcagcgcaagcacggcgggatgctggtccggaaccccctcagcagaaattctacccatgagatgtactgggtgtcctgcggaacaggcaacattgttagcgccgtgaatatgacctctcgcatgctgctgaacagattcacaatggctcaccggaaaccgacctatgaacgcgatgtcgacctcggggccggaacgagacacgtggctgtggagcctgaagtcgccaacctggatatcattggccagcggatcgagaatattaagcatgaacacaagtccacctggcattacgacgaggataacccctataaaacatgggcttaccacgggagctatgaggttaagccctctggatccgccagctccatggtgaatggcgtggtcaaacttctgaccaagccttgggacgtgatccccatggttacacaaatcgcgatgaccgatacaaccccttttggccagcagagagtgttcaaagaaaaggtcgacacgcggacaccgaaggccaaacgcgggaccgctcaaattatggaggtgaccgccaagtggctctggggatttctgagcagaaacaaaaagccccggatctgtacacgcgaagagttcacgagaaaagttcggtctaatgctgccattggcgccgtgtttgtcgacgaaaaccagtggaatagcgcgaaggaggctgtggaggatgaacgcttctgggaccttgttcatagagagcgggaactgcacaagcaggggaaatgcgccacctgcgtgtacaacatgatgggaaagcgcgagaaaaagctcggcgaatttgggaaagccaagggctccagagctatctggtacatgtggctgggagcccggttcctggagttcgaggctctcggctttatgaatgaagatcactggttctctcgcgagaacagcctgtccggggtcgaaggagagggccttcataagctggggtatattctcagagacatctctaaaatccctggaggcaatatgtacgccgatgacacagcggggtgggatacccggattacagaggacgatctgcagaacgaagcccgcatcaccgacattatggagcccgaacacgctcttctggccaagagcatctttaaactcacatatcaaaataaggtggtcagagtgcagcggcctgctaaaaacggcaccgttatggatgtgatttccagacgcgaccagcggggatctggccaggtcgggacgtacggactgaataccttcacaaacatggaggcccaactgatcagacagatggaaagcgagggcatcttttcccccagcgagctcgaaaccccgaacctggcggagcgcgtgcttgattggctggaaaagtatggggtggagcggctcaaaagaatggccatttctggagacgactgtgttgtgaagcctatcgatgaccgcttcgctacagccctgaccgctcttaatgatatgggcaaggtccggaaagacattccccagtgggaaccttccaaggggtggaacgattggcagcaagtgcccttttgcagccatcacttccaccagctgatcatgaaagacggcagagagattgttgtgccttgtcgcaatcaggatgagctcgtcggacgggccagagtgtctcagggcgctgggtggtccctgcgcgaaacggcctgcctgggaaagagctacgcgcaaatgtggcagctcatgtattttcatcggagagacctgcggcttgccgctaacgccatctgttccgccgtccccgtggattggattccgacatctagaaccacatggagcatccacgctcatcaccagtggatgaccacggaggacatgctgtccgtttggaatcgcgtgtggatcgaagagaacccttggatggaagataaaacccatattagctcttggggcgacgtcccctacctcgggaagcgggaggaccaatggtgcggatccctgatcggccttacagccagagcgacctgggctacaaatattcaggtggccatcaaccaggttcgcagactgattgggaatgagaactacctcgattatatgaccagcatgaagcggttcaaaaatgaatctgaccccgagggcgccctgtggtga

SEQ ID NO: 18525 - RNA, 9879 nt, synthetic construct
  misc_feature 1..9879: note = derived and/or modified CDS sequence (opt5) from DENV-1__GU131888__SS-prME
  source 1..9879: mol_type = other RNA
agcgtgaccatgctgctgatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagtctgcctggaaacagattcagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtgggctgttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcctgacccaagatgaaaagggcgttacacagaacgggcggcttattacggctaatcccatcgtgaccgacaaagagaagcctgtcaacattgaagccgagccgccctttggagagagctatatcgtgattggcgccggggaaaaagctctcaagctgtcttggttcaagaaaggaagctccatcggcaagatgtttgaggccacagctagaggggcccgccggatggcgatcctgggcgataccggatgggacttcggctctattgggggagtgtttacaagcgttggcaaactcgtccatcagatcttcgggaccgcctacggagtgctgttttccggcgtgagctggacgatgaagattgggatcggcgtccttctgacctggctcggactcaattctagatccacaagcctgtctatgacctgtattgctgtgggccttgttacactctacctgggggtgatggtccaggccgattccggatgcgtgatcaactggaaaggccgcgaactgaagtgtgggagcggaattttcgttaccaatgaggtgcacacatggaccgaacaatataagtttcaggctgactcccctaaacggctctctgccgcgatcggcaaggcctgggaggagggggtctgcggcatcagaagcgctacgcgcctggaaaacattatgtggaaacagatctccaacgagcttaatcatattctgctcgaaaacgacatgaagttcacagtggttgtgggagatgtcgccggcatcctggctcaggggaaaaagatgattcggccgcaacccatggagtacaaatattcttggaaaagctggggaaaggccaagatcatcggcgccgacgtgcagaataccacctttattatcgatgggcctaacacacccgaatgtcctgacgatcagagagcttggaatatttgggaggtggaggactacggattcggcatctttaccacgaacatttggctgaaacttcgcgattcctatacacaggtctgcgaccaccggctcatgagcgcggccatcaaagattctaaggctgttcacgccgacatgggctactggatcgaatccgagaaaaatgaaacctggaagctggccagagctagcttcattgaggtgaagacatgtatctggcccaaatctcataccctgtggtccaacggggtgctcgaaagcgagatgattatcccgaagatttatggaggccctatctctcaacacaattaccgccccgggtacttcacacagaccgccggaccttggcatctgggcaaacttgagctggattttgacctctgcgaagggacgaccgtcgtggttgatgagcactgcggaaaccggggccccagcctgagaacaaccacagtgaccggcaagatcattcacgaatggtgttgccggtcctgtacgctgcctccccttcgcttcagaggggaggacggatgctggtatggcatggagatccggccggtcaaagaaaaggaggaaaatctcgtgaagtccatggtttctgcggggtccggagaggtggacagcttttccctgggcctgctctgtatttctatcatgattgaagaggtcatgagaagccgctggtcccggaaaatgctgatgacagggacccttgctgtgttcctgctcctgatcatgggacagctgacatggaacgatcttattagactgtgcatcatggttggcgccaatgcctctgaccgcatgggcatggggaccacctacctcgctctgatggccacatttaagatgagacctatgttcgcggtgggactcctgtttcggcgccttacgagcagagaggtcctgctcctgaccatcggcctgtcccttgtggcttctgtggaactgcccaacagcctcgaggaactgggggatggactcgccatgggcattatgatcctgaaacttctgacagacttccaatcccatcagctctgggccaccctgctgagccttacatttattaagaccacgttctctctgcactatgcttggaaaacaatggccatggtcctctccatcgttagcctgtttcccctctgtctgtctaccacctcccagaagacaacctggcttcctgtgctgctggggagcctcggatgcaagccgctgacaatgttccttattgctgagaataaaatctggggccggcgctcttggcccctgaacgaaggcatcatggccgtggggattgtctccatcctcctgagctccctcctgaagaacgatgtgcctcttgcgggacccctgattgccggcgggatgctgatcgcttgttacgttattagcggatctagcgccgacctctccctggagaaagctgccgaggtgtcttgggaagaggaagccgagcatagcggcgcttcccacaatatccttgtcgaagtgcaggatgacgggcctatgaagatcaaagatgaggagagagacgatacgctgaccattctcctgaaggcgacactcctggccgtttctggagtgtatccccttagcatccctgctaccctgtttgtctggtacttctggcagaagaagaagcagcggtccggcgtgctgtgggacacaccctctccgcctgaagtcgagcgcgccgtgctcgatgacggcatttatagaatcatgcagcgggggctgcttggacgcagccaggttggcgtgggggtcttccaagaaaacgtgtttcataccatgtggcacgttacgagaggagccgtgctgatgtaccagggcaaacggctcgagccctcctgggctagcgtcaagaaagacctgatttcttacgggggaggctggagactccagggctcctggaataccggggaggaagtgcaagtgatcgccgttgagcctggaaagaaccccaaaaatgtccaaacagcgccgggcaccttcaagacacctgaaggggaggtgggagctattgccctggattttaagcccggcaccagcgggtctcctatcgtgaaccgcgaaggaaaaatcgtcggcctttatggcaatggggtggttacaacgtccggaacctacgtgagcgccattgctcaggccaaggcgtcccaggagggccccctgcccgagatcgaagacgaggtcttccggaaaagaaacctgacaattatggatctccaccctgggtctggaaagacccgccggtatctgccggctatcgtgagagaagccattaaacgcaaacttcggaccctgatcctcgcccccacaagagttgtggctagcgagatggccgaagctctgaagggcatgcctatccgctaccaaacgaccgccgtcaaatccgagcatacagggaaggagattgtggacctgatgtgccacgcgacctttacaatgcggctccttagccccgttagagtgcctaattataacatgatcattatggatgaagcccatttcaccgacccctcttccatcgctgcccggggctacattagcacgcgcgtcggaatgggcgaggctgccgccatctttatgacagctacccctccggggtctgtggaagcgttcccccagagcaatgccctgatccaggatgaggaaagagacattcctgagcggtcctggaactctggatatgagtggatcaccgattttcccggcaaaacagtgtggttcgtccctagcattaagtccgggaatgacatcgctaactgtctgcgcaaaaatggaaagagagttattcagctctctcggaagacctttgatacagaataccagaagaccaagaacaacgactgggactacgtggtgacgacagatatcagcgagatgggcgccaatttcagagccgaccgcgtcattgatccccggagatgcctgaaaccggtgatccttaaggacgggcctgaacgcgttatcctggctggccccatgcccgtgaccgtcgcctccgcggctcagcggagaggacgcattggccggaaccacaataaagagggggatcagtatatctacatgggacagcctctcaacaatgacgaggatcatgcccactggacagaagccaagatgctgctggacaacattaatacccccgagggcatcattcctgctctcttcgaaccggagagagaaaagagcgccgcgatcgatggggagtatcgccttagaggagaggcccggaaaacgtttgtggaactgatgcgcagaggcgacctgcccgtttggctctcttacaaggtggcttccgaggggttccaatatagcgatcggcgctggtgctttgacggcgaaagaaacaatcaggtcctggaggaaaacatggatgtggagatctggaccaaagagggagaacggaagaaacttagacctcgctggctggacgcccggacatactccgaccccctcgctctgagagagttcaaggaatttgccgctggccgccggtctgtcagcggggatctgattctcgagatcggaaaacttcctcagcacctgacccagagagcccaaaatgcgctggacaacctcgtgatgctgcataattccgaacagggcgggcgggcctatcgccacgctatggaggagcttcccgatacaattgaaaccctgatgctcctggccctgatcgctgttctcacaggaggcgtgacccttttctttctgtctggcagagggctgggaaagacgagcattggcctcctgtgtgtgatggcctccagcgtccttctgtggatggcctctgttgagccgcattggatcgctgcgtccatcattctcgagttctttctgatggtgctgctcatccctgagcccgaccggcagcgcacacctcaggataaccaacttgcctacgtggtcattgggctgctgttcatgatcctcaccgtggctgccaatgagatgggactgcttgaaaccacaaagaaagacctgggcattgggcacgttgccgtgggaaaccaccatcacgctgccatgctcgatgtcgacctgcatcccgcgagcgcctggaccctgtacgctgtggccacaacgatcattacccctatgatgagacacacaatcgagaacaccacagctaatatctctctcaccgccattgcgaaccaggccgctatccttatgggcctggataagggctggcccatttccaaaatggacatcggggtcccgctgctcgccctgggatgctatagccaggtgaatcctcttacgctgaccgctgccgttctcatgctggtggctcattacgccattatcggccccgggctgcaagcgaaggccacacgggaagctcagaaacgcaccgccgctggaatcatgaagaaccccacagtcgatggcattgtggccatcgacctcgatcctgttgtgtatgacgccaagtttgagaaacagcttgggcagattatgctgctgatcctctgtacctctcaaattctgcttatgagaacgacatgggcgctgtgcgaaagcatcaccctcgctacaggaccgctgaccaccctgtgggagggctcccccggcaagttctggaatacaacgatcgccgtctctatggctaacatttttcgggggagctacctcgccggagccggccttgctttctccctgatgaaaagcctcgggggaggccgcagagggaccggagcccagggcgagacactcggcgaaaagtggaaacggcagctgaatcagctttccaagtctgagttcaacacctataagagaagcgggatcatggaagtggaccgctccgaggcgaaagaaggactgaagcggggcgagacaaccaaacacgccgtgtctagagggacggctaagctccgctggtttgttgagcggaatctggtcaaacctgaaggaaaggtgattgatctgggctgtgggagaggaggctggagctactattgcgccggcctcaagaaagtgacagaggtcaaggggtacaccaaaggaggccccgggcacgaagaacctatccccatggctacctacggatggaaccttgttaagctgcattccggcaaagacgtgttctttattcctccggaaaagtgtgatacactgctctgcgacatcggggagtctagccccaatcctaccattgaggaaggacgcacactgcgggtgcttaaaatggtcgagccctggctgagaggcaaccaattctgtatcaagatcctcaatccttatatgccctccgtggttgaaacgctggagcagatgcagcgcaagcacggcgggatgctggtgcggaacccgctcagcagaaattctacccatgagatgtactgggtctcctgcggaacaggcaacattgtgagcgccgttaatatgacctctcgcatgctgcttaaccggtttacaatggcgcacagaaaacctacctatgaacgcgatgtggacctgggggccggaacgagacacgtcgctgtggagcccgaagtggccaacctcgatatcattggccagcggatcgagaatattaagcatgaacacaaatccacctggcattacgacgaggataacccctataagacatgggcttaccacgggagctatgaggtcaaaccttctggatccgccagctccatggttaatggcgtggtgaagctgcttaccaagccctgggacgtcatccctatggtgacacaaatcgctatgaccgatacaaccccgttcggccagcagcgcgtttttaaagaaaaggtggacacgagaacacccaaagccaagcgggggaccgcgcaaattatggaggtcaccgccaaatggctgtggggattcctcagcagaaacaagaagcctcggatctgtacacgcgaagagtttacgagaaaagtgcggtctaatgctgccattggcgctgttttcgtggacgaaaaccagtggaatagcgccaaggaggccgtcgaggatgaacgcttttgggacctggtgcatagagagcgggaactgcacaaacaggggaagtgcgcgacctgcgtttacaacatgatgggaaaacgcgagaagaagctcggcgagttcgggaaagctaagggctccagagccatctggtacatgtggctgggagcccggtttcttgagttcgaggctctgggcttcatgaatgaagatcactggttttctcgcgagaacagcctctccggggtggaaggagagggcctgcataaacttgggtatattctgagagacatctctaagatccccggaggcaatatgtacgccgatgacacagctgggtgggatacccggattacagaggacgatctccagaacgaagcccgcatcaccgacattatggagcctgaacacgcgctgctggccaaaagcatcttcaagctcacatatcaaaataaagtcgtgagagtccagcggcccgctaagaacggcaccgtgatggatgttatttcccgcagagaccagcggggatctggccaggtggggacgtacggactgaatacctttacaaacatggaggcccaacttatcagacagatggaaagcgagggcatcttctccccgagcgagctggaaacccctaacctcgctgagcgcgtcctggattggcttgaaaagtatggggtggagcggctgaaaagaatggccatttctggagacgactgtgtggttaagcccatcgatgaccgctttgcgacagccctcaccgctctgaatgatatgggcaaagtgcggaaggacattcctcagtgggaaccctccaaagggtggaacgattggcagcaagtccctttctgcagccatcactttcaccagctgatcatgaaggacggcagagagattgtggttccctgtcgcaatcaggatgagctcgtgggacgggccagagtctctcagggcgctgggtggtccctgcgcgaaacggcctgccttggaaagagctacgctcaaatgtggcagctgatgtatttccatcggagagacctccgcctggccgcgaacgccatctgttccgctgtgccggtcgattggattcctacatctcggaccacatggagcatccacgcccatcaccagtggatgaccacggaggacatgctttccgtgtggaatagagtttggatcgaagagaacccctggatggaagataaaacccatattagctcttggggcgacgtgccctacctggggaagcgggaggaccaatggtgcggatccctcatcggcctgacagccagagctacctgggccacaaatattcaggtcgcgatcaaccaggtgcgccggctgattgggaatgagaactacctcgattatatgaccagcatgaaaagatttaagaatgaatctgaccctgagggcgctctgtggtga

SEQ ID NO: 18526 - RNA, 9879 nt, synthetic construct
  misc_feature 1..9879: note = derived and/or modified CDS sequence (opt5) from DENV-1__GU131892__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgtgcaggggaaaaagatgattcggccgcaacccatggagtacaaatattcttggaaaagctggggaaaggccaagatcatcggcgccgacgtgcagaataccacctttattatcgatgggcctaacacacccgaatgtcctgacgatcagagagcttggaatatttgggaggtcgaggactacggattcggcatctttaccacgaacatttggctgaagctgcgcgattcctatacacaggtttgcgaccaccggcttatgagcgcggccatcaaagattctaaggctgtgcacgccgacatgggctactggatcgaatccgagaaaaatgaaacctggaagctcgccagagctagcttcattgaggtgaagacatgtatctggcccaaatctcataccctgtggtccaacggggtcctggaaagcgagatgattatcccgaagatttatggaggccctatctctcaacacaattaccgccccgggtacttcacacagaccgccggaccttggcatctcggcaaactggagcttgattttgacctgtgcgaagggacgaccgtggttgtggatgagcactgcggaaaccggggccccagcctcagaacaaccacagtcaccggcaagatcattcacgaatggtgttgccggtcctgtacgctgcctcccctgcgcttcagaggggaggacggatgctggtatggcatggagatccggccggtgaaagaaaaggaggaaaatcttgttaagagcatggtgtctgcggggtccggagaggtcgacagcttttccctcggcctgctgtgtatttctatcatgattgaagaggtgatgagaagccgctggtcccggaaaatgctcatgacagggaccctggctgttttccttctgctcatcatgggacagctgacatggaacgatctgattagactttgcatcatggtgggcgccaatgcctctgaccgcatgggcatggggaccacctacctggctctcatggccacatttaagatgagacctatgttcgcggtcggactgctctttcggcgcctgacgagcagagaggtgcttctgctcaccatcggcctgtccctggtggcttctgtcgaacttcccaacagcctggaggaactcggggatggactggccatgggcattatgatcctcaaactgcttacagacttccaatcccatcagctgtgggccaccctcctgagcctgacatttattaagaccacgttctctcttcactatgcttggaaaacaatggccatggttctgtccatcgtgagcctctttcccctgtgtctctctaccacctcccagaagacaacctggctgcctgtgcttctggggagcctgggatgcaagccgctcacaatgttcctgattgctgagaataaaatctggggccggcgctcttggccccttaacgaaggcatcatggccgtcgggattgtgtccatcctgctcagctccctgctcaagaacgatgttcctctggcgggaccccttattgccggcgggatgctgatcgcttgttacgtgattagcggatctagcgccgacctgtccctcgagaaagctgccgaggtctcttgggaagaggaagccgagcatagcggcgcttcccacaatatcctggtggaagttcaggatgacgggacgatgaagatcaaagatgaggagagagacgatacccttacaattctgctcaaggcgaccctgctcgccgtgtctggagtctatcctctgagcatccccgctacactttttgtgtggtacttctggcagaagaagaagcagcggtccggcgtcctgtgggacaccccttctcccccggaagtggagcgcgccgttctggatgacggcatttatagaatcatgcagcgggggctcctgggacgcagccaggtgggcgtcggggtgttccaagaaaacgtttttcatacgatgtggcacgtgaccagaggagccgtccttatgtaccagggcaaacggctggagccttcctgggctagcgtgaagaaagacctcatttcttacgggggaggctggagactgcagggctcctggaatacaggggaggaagtgcaggttatcgccgtcgagcccggaaagaaccctaaaaatgtgcaaaccgcgcccggcacattcaagaccccggaaggggaggtgggagctattgccctcgattttaagcctggcacaagcgggtctcccatcgtcaaccgcgaaggaaaaatcgtgggcctgtatggcaatggggttgtgacgacctccggaacatacgtcagcgccattgctcaggccaaggcgtcccaggagggccctcttcccgagatcgaagacgaggtgttccggaaaagaaacctgaccattatggatctgcaccccgggtctggaaagacccgccggtatctccctgctatcgttagagaagccattaaacgcaagctgcggacacttatcctggccccgacgagagtggtcgctagcgagatggccgaagctctcaagggcatgcccatccgctaccaaaccacagccgtgaaatccgagcataccgggaaggagattgttgacctgatgtgccacgcgacatttaccatgcggctgctcagccctgtgagagtccccaattataacatgatcattatggatgaagcccatttcacggacccttcttccatcgctgcccggggctacattagcacacgcgtgggaatgggcgaggctgccgccatctttatgaccgctacaccccctgggtctgtggaagcgttcccgcagagcaatgccgtcatccaggatgaggaaagagacattcccgagcggtcctggaactctggatatgagtggatcacagattttcctggcaaaaccgtttggttcgtgcccagcattaagtccgggaatgacatcgctaactgtcttcgcaaaaatggaaagagagtgattcagctgtctcggaagacatttgataccgaataccagaaaacgaagaacaacgactgggactacgtcgtgacaaccgatatcagcgagatgggcgccaatttcagagccgaccgcgttattgatcctcggagatgcctgaaacccgtgatcctcaaggacgggccggaacgcgtcatcctggctggccctatgcccgtgacagttgcctccgcggctcagcggagaggacgcattggccggaaccacaataaagagggggatcagtatatctacatgggacagccccttaacaatgacgaggatcatgcccactggaccgaagccaagatgctgctcgacaacattaatacgcctgagggcatcattcccgctctgttcgaacctgagagagaaaagagcgccgcgatcgatggggagtatcgcctgagaggagaggcccggaaaacctttgtggaactcatgcgcagaggcgaccttccggtctggctgtcttacaaggtggcttccgaggggttccaatatagcgatcggcgctggtgctttgacggcgaaagaaacaatcaggtcctggaggaaaacatggatgtggagatctggacaaaagagggagaacggaagaaactcagaccccgctggctggacgcccggacctactccgaccctcttgctctgagagagttcaaggaatttgccgctggccgccggtctgttagcggggatctcattctggagatcggaaaactgccccagcacctcacacagagagcccaaaatgcgcttgacaacctggtgatgctgcataattccgaacagggcgggcgggcctatcgccacgctatggaggagctccctgataccattgaaacactgatgcttctggccctcatcgctgtgctgaccggaggcgtcacgctgttctttctctctggcagagggcttggaaagacaagcattggcctgctgtgtgttatggcctccagcgtgctcctgtggatggcctctgtggagccccattggatcgctgcgtccatcattcttgagttctttctgatggtcctcctgatcccggagcctgaccggcagcgcacaccccaagataaccaactggcctacgtggttattgggctccttttcatgatcctgaccgtggctgccaatgagatgggactgctcgaaaccaccaagaaagacctgggcattgggcacgtcgccgtgggaaaccaccatcacgctgccatgcttgatgtcgacctgcatcctgcgagcgcctggacactctacgctgtggccacgaccatcattacacccatgatgagacacaccatcgagaacacaaccgctaatatctctctgacggccattgcgaaccaggccgctatcctgatgggcctcgataagggctggcctatttccaaaatggacatcggggttccccttctggccctgggatgctatagccaggtgaatccgctcaccctgacagctgccgtccttatgctggtggctcattacgccattatcggccctgggctccaagcgaaggccacccgggaagctcagaaacgcacagccgctggaatcatgaagaaccccaccgttgatggcattgtggccatcgacctggatcccgtcgtgtatgacgccaagtttgagaaacagctggggcagattatgctccttatcctgtgtacgtctcaaattctgctcatgagaacaacctgggcgctgtgcgaaagcatcacacttgctaccggacctctgaccacactctgggagggctccccgggcaagttctggaatacgaccatcgccgtgtctatggctaacatttttcgggggagctacctggccggagccggcctggctttctccctcatgaaaagccttgggggaggccgcagagggacaggagcccagggcgagaccctgggcgaaaagtggaaacggcagctgaatcagctctccaagtctgagttcaacacatataagagaagcgggatcatggaagttgaccgctccgaggcgaaagaaggactgaagcggggcgagaccacgaaacacgccgtctctagagggacagctaaacttcgctggtttgtggagcggaatctggtgaaacccgaaggaaaggtcattgatctcggctgtgggagaggaggctggagctactattgcgccggcctgaagaaagttaccgaggtgaaggggtacaccaaaggaggccctgggcacgaagaacccatccctatggctacatacggatggaacctggtgaagctccattccggcaaagacgtcttctttattccccctgaaaagtgtgatacccttctgtgcgacatcggggagtctagcccgaatcccacaattgaggaaggacgcacgctgcgggtgctcaaaatggttgagccttggctgagaggcaaccaattctgtatcaagatccttaatccctatatgccttccgtggtcgaaaccctggagcagatgcagcgcaagcacggcgggatgctcgtgcggaaccccctgagcagaaattctacacatgagatgtactgggtttcctgcggaaccggcaacattgtgagcgccgtcaatatgacatctcgcatgctgctcaaccggtttaccatggcgcacagaaaaccgacgtatgaacgcgatgtggacctgggggccggaaccagacacgtggctgtcgagcctgaagttgccaaccttgatatcattggccagcggatcgagaatattaagcatgaacacaaatccacatggcattacgacgaggataacccctataagacctgggcttaccacgggagctatgaggtgaaaccctctggatccgccagctccatggtgaatggcgtcgtgaagctgctcacaaagccttgggacgttatccccatggtgacccaaatcgctatgacagataccacgcctttcggccagcagcgcgtctttaaagaaaaggtggacacaagaaccccgaaagccaagcgggggaccgcgcaaattatggaggttacagccaaatggctgtggggattccttagcagaaacaagaagccccggatctgtacgcgcgaagagtttaccagaaaagtgcggtctaatgctgccattggcgctgtcttcgtggacgaaaaccagtggaatagcgccaaggaggccgttgaggatgaacgcttttgggacctggtgcatagagagcgggaactccacaaacaggggaagtgcgcgacatgcgtctacaacatgatgggaaaacgcgagaagaagctgggcgagttcgggaaagctaagggctccagagccatctggtacatgtggctgggagcccggtttctcgagttcgaggctctgggcttcatgaatgaagatcactggttttctcgcgagaacagcctttccggggtggaaggagagggcctgcataaactcgggtatattctgagagacatctctaagatccctggaggcaatatgtacgccgatgacaccgctgggtgggatacacggattaccgaggacgatcttcagaacgaagcccgcatcacagacattatggagcccgaacacgcgctgctcgccaaaagcatcttcaagctgacctatcaaaataaagtcgtgagagttcagcggcctgctaagaacggcacggtgatggatgtcatttcccgcagagaccagcggggatctggccaggtggggacctacggactgaatacatttaccaacatggaggcccaactcatcagacagatggaaagcgagggcatcttctcccccagcgagctggaaacaccgaaccttgctgagcgcgtgctggattggctcgaaaagtatggggttgagcggctgaaaagaatggccatttctggagacgactgtgtggtcaagcctatcgatgaccgctttgcgaccgcccttacggctctgaatgatatgggcaaagtgcggaaggacattccccagtgggaaccttccaaagggtggaacgattggcagcaagttcccttctgcagccatcactttcaccagctcatcatgaaggacggcagagagattgtggtcccttgtcgcaatcaggatgagctggtgggacgggccagagtctctcagggcgctgggtggtccctgcgcgaaacagcctgcctcggaaagagctacgctcaaatgtggcagctgatgtatttccatcggagagaccttcgcctggccgcgaacgccatctgttccgctgtgcccgttgattggattccgacctctcggacaacctggagcatccacgcccatcaccagtggatgacgaccgaggacatgctctccgtgtggaatagagtctggatcgaagagaacccttggatggaagataaaacacatattagctcttggggcgacgtgccctacctggggaagcgggaggaccaatggtgcggatcccttatcggcctgaccgccagagctacatgggccaccaatattcaggttgcgatcaaccaggtgcgccggctcattgggaatgagaactacctggattatatgacaagcatgaaaagatttaagaatgaatctgaccccgagggcgctctgtggtga

SEQ ID NO: 18527 - RNA, 9879 nt, synthetic construct
  misc_feature 1..9879: note = derived and/or modified CDS sequence (opt5) from DENV-1__GU131893__SS-prME
  source 1..9879: mol_type = other RNA
agcgtgaccatgctgctgatgctgatgcccacagcccttgctttccacctgacgaccagaggcggggagcctcatatgatcgtctccaagcaggaacggggaaagtctctcctgtttaagaccagcgccggcgttaacatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgatgacctgcgccaagtttaagtgcgtcacaaaacttgagggaaagatcgtgcagtacgaaaacctgaaatattccgttatcgtgacggtccacaccggcgaccagcatcaagtggggaatgagagcacagaacacggaaccacagctaccattacgccccaggcccctaccacagagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggctacacagaacggacggctgatcacggccaatcccattgttaccgacaaagagaagcctgtgaacatcgaagccgagccgccctttggcgagagctatattgtcatcggggctggagaaaaagcccttaagctctcttggttcaagaaaggcagctccattgggaagatgtttgaggctacagccagaggcgcgcgccggatggccatcctgggagataccgcttgggacttcggctctatcgggggagtgtttacaagcgtgggcaaactggttcatcagattttcgggaccgcctacggagtcctcttttccggcgtgagctggacgatgaagatcgggctgggcgtgcttctgacctggctcggactcaattctagatccacaagcctgtctatgacctgtattgctgtcggccttgtgacactctacctgggggttatggtgcaggccgattccggatgcgtcatcaactggaaaggccgcgaactgaagtgtgggagcggaattttcgtgaccaatgaggttcacacatggaccgaacaatataagtttcaggcggactcccctaaacggctctctgccgctatcggcaaggcctgggaggagggggtgtgcggcattagaagcgctacgcgcctggaaaacatcatgtggaaacagatctccaacgagcttaatcatattctgctcgaaaacgacatgaagttcacagtcgtggttggagatgtggccggcatcctggcccaggggaaaaagatgattcggccgcaacccatggagtacaaatattcttggaaaagctggggaaaggctaagatcattggcgcggacgtccagaataccacctttatcatcgatgggcctaacacacccgaatgtcctgacgatcagagagcctggaatatttgggaggtggaggactacggattcggcatctttaccacgaacatttggctgaaacttcgcgattcccacacacaggtgtgcgaccaccggctcatgagcgctgccatcaaagattctaaggccgtccatgctgacatgggctattggattgaatccgagaaaaatgaaacctggaagctggccagagcgagcttcatcgaggttaagacatgtatctggcccaaatctcacaccctgtggtccaacggggtgctcgaaagcgagatgattatcccgaagatttacggaggccctatctctcaacataattatcgccccgggtacttcacacagaccgctggaccttggcacctgggcaaacttgagctggattttgacctctgcgaagggacgaccgtggtcgtggatgagcactgcggaaaccggggccccagcctgagaacaaccacagttaccggcaagattatccatgaatggtgttgccggtcctgtacgctgcctccccttcgcttcagaggggaggacggatgctggtacggcatggagatccggccggtgaaagaaaaggaggaaaatctcgtcaagagcatggtgtctgccgggtccggagaggttgacagcttttccctgggcctgctctgtatttctatcatgattgaagaggtgatgagaagccgctggtcccggaaaatgctgatgacagggacccttgccgtcttcctgctcctgatcatgggacagctgacatggaacgatcttattagactgtgcatcatggtgggcgctaatgcctctgaccgcatgggcatggggaccacctatctcgcgctgatggctacatttaagatgagacctatgttcgccgttggactcctgtttcggcgccttacgagcagagaggtgctgctcctgaccattggcctgtcccttgtcgcctctgtggaactgcccaacagcctcgaggaactgggggatggactcgctatgggcatcatgatcctgaaacttctgacagacttccaatcccaccagctctgggccaccctgctgagccttacatttattaagaccacgttctctctgcattacgcttggaaaacaatggccatggtgctctccatcgtcagcctgtttcccctctgtctgtctaccacctcccagaagacaacctggcttcctgttctgctggggagcctcggatgcaagccgctgacaatgttccttattgcggagaataaaatctggggccggcgctcttggcccctgaacgaaggcattatggccgtggggatcgtgtccatcctcctgagctccctcctgaagaacgatgtccctcttgctggacccctgattgccggcgggatgctgatcgcttgttatgtgattagcggatctagcgccgacctctccctggagaaagccgctgaggtttcttgggaagaggaagcggagcacagcggcgcctcccataatatccttgtggaagtccaggatgacgggacgatgaagattaaagatgaggagagagacgataccctgacaatcctcctgaaggctaccctcctggccgtgtctggagtttaccctcttagcatccccgccacactgtttgtgtggtatttctggcagaagaagaagcagcggtccggcgtcctgtgggacaccccttctcccccggaagtggagcgcgctgtcctcgatgacggcatttacagaatcatgcagcgggggctgcttggacgcagccaggtgggcgttggggtgttccaagaaaacgtctttcacacgatgtggcacgtgaccagaggagccgttctgatgtatcagggcaaacggctcgagccttcctgggcgagcgtgaagaaagacctgatttcttacgggggaggctggagactccagggctcctggaatacaggggaggaagtccaggtgatcgctgtggagcccggaaagaaccctaaaaatgttcaaaccgcccccggcacattcaagaccccggaaggggaggtcggagccattgctctggattttaagcctggcacaagcgggtctcccatcgtgaaccgcgaaggaaaaattgtgggcctttacggcaatggggtcgtgacgacctccggaacatatgttagcgccatcgcgcaggctaaggcctcccaggagggccctctgcccgagatcgaagacgaggtgttccggaaaagaaacctgaccattatggatctccatcccgggtctggaaagacccgccggtacctgcctgccatcgtcagagaagctattaaacgcaaacttcggacactgatcctcgccccgacgagagtggttgctagcgagatggccgaagcgctgaagggcatgcccattcgctatcaaaccacagccgtgaaatccgagcacaccgggaaggagatcgtcgacctgatgtgccatgctacatttaccatgcggctccttagccctgtgagagttcccaattacaacatgatcattatggatgaagcccacttcacggacccttcttccatcgctgcccggggctatattagcacacgcgtgggaatgggcgaggccgctgcgatctttatgaccgccacaccccctgggtctgtcgaggctttcccgcagagcaatgccgtgattcaggatgaggaaagagacatccccgagcggtcctggaactctggatacgagtggatcacagattttcctggcaaaaccgtgtggttcgtccccagcattaagtccgggaatgacatcgccaactgtctgcgcaaaaatggaaagagagttattcagctgtctcggaagacatttgataccgaatatcagaagacgaagaacaacgactgggactacgtggtgacaaccgatatcagcgagatgggcgctaatttcagagccgaccgcgtcattgatcctcggagatgcctcaaacccgtgatcctgaaggacgggccggaacgcgttattcttgcgggccctatgcccgtgacagtcgcttccgccgcccagcggagaggacgcatcggccggagccataacaaagagggggatcagtacatctatatgggacagcccctgaataacgacgaggatcacgctcactggaccgaagccaagatgctcctggacaatattaacacgcctgagggcatcattcccgcgctgttcgaacctgagagagaaaagtctgccgctatcgatggggagtaccgcctcagaggagaggcccggaaaacctttgtggaacttatgcgcagaggcgacctgccggtttggctgtcctataaggtggctagcgaggggttccaatactccgatcggcgctggtgctttgacggcgaaagaaataaccaggtcctcgaggaaaatatggatgtggagatttggacaaaagagggagaacggaagaaactgagaccccgctggcttgacgcccggacctattctgaccctctggctctcagagagttcaaggaatttgccgcgggccgccggagcgtctccggggatctgatcctggagatcggaaaactcccccagcatcttacacagagagcccaaaacgctctggacaatctggtgatgctccacaactctgaacagggcgggcgggcctaccgccatgctatggaggagctgcctgataccattgaaacacttatgctgctcgccctgatcgccgttctgaccggaggcgtgacgctgttctttcttagcggcagagggctgggaaagacatccattggcctgctctgtgtgatggctagctctgtcctgctttggatggcgtccgttgagccccactggatcgccgctagcattatcctggagttctttctcatggtgctgctgatcccggagcctgaccggcagcgcacaccccaagataatcaactcgcctatgtggtcattgggcttctgttcatgatcctgaccgtggccgctaacgagatgggactcctggaaaccaccaagaaagaccttggcattgggcacgttgccgtgggaaatcatcaccatgcggccatgctggatgtcgacctccaccctgcttctgcctggacactgtacgctgtggccacgaccatcattacacccatgatgagacataccatcgagaacacaaccgcgaacatttccctgacggccatcgctaatcaggccgctatcctcatgggccttgataagggctggcctattagcaaaatggacatcggggtccccctgctggccctcggatgctactctcaggtgaacccgctgacccttacagctgccgttctgatgctcgtggcgcactatgccattatcggccctgggctgcaagctaaggccacccgggaagctcagaaacgcacagccgccggaattatgaagaatcccaccgtcgatggcatcgtggcgatcgacctggatcccgttgtgtacgacgctaagtttgagaaacagctcgggcagattatgcttctgatcctgtgtacgagccaaattctcctgatgagaacaacctgggccctttgcgaatccatcacactggctaccggacctctcaccacactgtgggagggctctccgggcaagttctggaacacgaccattgccgtcagcatggccaatatctttcgggggtcctatctggctggagccggcctcgcgttcagccttatgaaatccctcgggggaggccgcagagggacaggagcccagggcgagaccctgggcgaaaagtggaaacggcagctcaaccagctgtctaagagcgagttcaatacatacaagagatccgggatcatggaagtggaccgctctgaggctaaagaaggacttaagcggggcgagaccacgaaacacgccgtgagcagagggacagctaagctgcgctggtttgttgagcggaacctcgtcaaacccgaaggaaaggtgattgatctgggctgtgggagaggaggctggtcctattactgcgccggcctgaagaaagtgaccgaggtcaaggggtataccaaaggaggccctgggcatgaagaacccatccctatggcgacatacggatggaatctcgttaaacttcactctggcaaagacgtgttctttattccccctgaaaagtgtgataccctgctgtgcgacatcggggagagctccccgaaccccacaattgaggaaggacgcacgctccgggtgctgaaaatggtcgagccttggcttagaggcaatcaattctgtatcaagattctgaacccctacatgcctagcgtggttgaaaccctcgagcagatgcagcgcaagcatggcgggatgctggtgcggaatcccctgtctagaaactccacacacgagatgtattgggtcagctgcggaaccggcaatatcgtgtctgccgttaacatgacatcccgcatgctcctgaatcggtttaccatggctcacagaaaaccgacgtacgaacgcgatgtggaccttggggccggaaccagacatgtcgctgtggagcctgaagtggccaacctggatatcattggccagcggatcgagaacattaagcacgaacataaaagcacatggcactatgacgaggataatccctacaagacctgggcttatcatgggtcttacgaggtcaaaccctccggaagcgcctccagcatggttaacggcgtggtgaagctcctgacaaagccttgggacgtcatccccatggtgacccaaattgcgatgacagataccacgcctttcggccagcagcgcgtttttaaagaaaaggtggacacaagaaccccgaaagccaagcgggggaccgctcaaatcatggaggtcacagccaaatggctttggggattcctgtctagaaataagaagccccggatctgtacgcgcgaagagtttaccagaaaagtgcggagcaacgctgccattggcgccgttttcgtggacgaaaatcagtggaactccgcgaaggaggctgtcgaggatgaacgcttttgggacctcgtgcacagagagcgggaactgcacaaacaggggaagtgcgccacatgcgtttataatatgatgggaaaacgcgagaagaagctgggcgagttcgggaaagccaagggctctagagctatctggtacatgtggctcggagcccggtttctggagttcgaggctcttggcttcatgaacgaagatcattggtttagccgcgaaaattccctgtctggggtggaaggagagggcctccacaaactggggtacattcttagagacatcagcaagattcctggaggcaacatgtatgccgatgacaccgcggggtgggatacacggatcaccgaggacgatctgcagaatgaagcccgcatcacagacattatggagcccgaacatgctctcctggccaaatccatcttcaagctgacctaccaaaacaaagtcgtgagagtccagcggcctgctaagaatggcacggtgatggatgttatttctcgcagagaccagcggggaagcggccaggtggggacctatggactcaacacatttaccaatatggaggcccaactgatcagacagatggaatccgagggcattttcagcccctctgagcttgaaacaccgaacctggcggagcgcgtcctcgtgtggctggaaaagtacggggtggagcggcttaaaagaatggccatctccggagatgactgtgttgtgaagcctatcgacgatcgctttgctaccgccctgacggctctcaacgacatgggcaaagtccggaaggatattccccagtgggaacctagcaaagggtggaatgactggcagcaagtgcccttctgctctcaccactttcatcagctgatcatgaaggatggcagagagattgttgtgccttgtcgcaaccaggacgagctggtcggacgggccagagtgtcccagggcgctgggtggagcctccgcgaaacagcctgcctgggaaagtcctatgcgcaaatgtggcagcttatgtacttccaccggagagatctgcgcctcgccgctaatgccatctgttctgccgtccccgtggactggattccgaccagccggacaacctggtccatccatgctcaccatcagtggatgacgaccgaggatatgctgagcgtttggaacagagtgtggattgaagagaatccttggatggaagacaaaacacacatctcttcctggggcgatgtcccctatcttgggaagcgggaggaccaatggtgcggaagcctgatcggcctcaccgccagagcgacatgggctaccaacattcaggtggccatcaatcaggttcgccggctgattgggaacgagaattacctggactacatgacatctatgaaaagatttaagaacgaaagcgatcccgagggcgccctctggtga

SEQ ID NO: 18528 - RNA, 9879 nt, synthetic construct
  misc_feature 1..9879: note = derived and/or modified CDS sequence (opt5) from DENV-1__GU131894__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgagaccacgaaacacgctgtttctagagggacagccaaacttcgctggtttgtcgagcggaatctggtgaaacccgaaggaaaggtgattgatctcggctgtgggagaggaggctggagctactattgcgctggcctgaagaaagtcaccgaggttaaggggtacaccaaaggaggccctgggcacgaagaacccatccctatggccacatacggatggaacctggtgaagctccattccggcaaagacgtgttctttattccccctgaaaagtgtgatacccttctgtgcgacatcggggagtctagcccgaatcccacaattgaggaaggacgcacgctgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgcggtgaatatgacatctcgcatgctgctcaaccggtttaccatggcccacagaaaaccgacgtatgaacgcgatgtcgacctgggggctggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagcgcgtgtttaaagaaaaggtcgacacaagaaccccgaaagcgaagcgggggaccgcccaaattatggaggtgacagctaaatggctgtggggattccttagcagaaacaagaagccccggatctgtacgcgcgaagagtttaccagaaaagttcggtctaatgccgctattggcgccgtgttcgtcgacgaaaaccagtggaatagcgccaaggaggcggtggaggatgaacgcttttgggacctggttcataaagagagagaactccacaagcaggggaaatgcgctacatgcgtgtacaacatgatgggaaagcgggagaagaaactgggcgagttcgggaaggccaaaggctcccgcgccatctggtacatgtggctgggagctagatttctcgagttcgaggccctgggcttcatgaatgaagatcactggttttctcgggagaacagcctttccggggtcgaaggagagggcctgcataagctcgggtatattctgcgcgacatctctaaaatccctggaggcaatatgtacgctgatgacaccgccgggtgggatacaagaattaccgaggacgatcttcagaacgaagcgcggatcacagacattatggagcccgaacacgccctgctcgctaagagcatcttcaaactgacctatcaaaataaggtggtccgcgtgcagagacctgccaagaacggcacggttatggatgtgatttcccggcgcgaccagagaggatctggccaggtcgggacctacggactgaatacatttaccaacatggaggctcaactcatccggcagatggaaagcgagggcatcttctcccccagcgagctggaaacaccgaaccttgccgagagagtgctggattggctcgaaaaatatggggtggagcgcctgaagcggatggcgatttctggagacgactgtgttgtgaaacctatcgatgacagatttgccaccgctcttacggccctgaatgatatgggcaaggtccgcaaagacattccccagtgggaaccttccaaggggtggaacgattggcagcaagtgcccttctgcagccatcactttcaccagctcatcatgaaggacggccgggagattgttgtgccttgtagaaatcaggatgagctggtcggacgcgctcgggtgtctcagggcgccgggtggtccctgagagaaacagcttgcctcggaaaaagctacgcccaaatgtggcagctgatgtatttccatcgccgggaccttagactggcggccaacgctatctgttccgccgtccccgtggattggaccccgacatctcgcaccacgtggagcattcacgcccatcaccagtggatgaccacagaggacatgctctccgtttggaatcgggtgtggatcgaagagaacccttggatggaagataagacccatatcagctcttggggcgacgtcccctacctggggaaaagagaggaccaatggtgcggatcccttattggcctgacagctcgggccacctgggcgacaaatatccaggtggctattaaccaggttagacgcctcatcgggaatgagaactacctggattatatgaccagcatgaagcggtttaaaaatgaatctgaccccgagggcgccctgtggtga

SEQ ID NO: 18529 - RNA, 9879 nt, synthetic construct
  misc_feature 1..9879: note = derived and/or modified CDS sequence (opt5) from DENV-1__GU131895__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttatcgccatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttgccctgaaggggatgagctatgttatgtgtacgggctctttcaaactcgagaaggaagtggcggagacacagcacggaaccgtcctggtgcagatcaagtacgagggcaccgacgctccgtgcaaaatccctttctccacacaagatgaaaagggggttacccagaacggacggctgattacagccaatcccatcgtgacggacaaagagaagcctgtcaacattgaagccgagccgccctttggcgagagctatatcgtgattggggctggagaaaaagcccttaagctctcttggttcaagaaaggcagctccatcgggaagatgtttgaggctaccgccagaggcgcgcgccggatggccatcctgggagatacagcttgggacttcggctctattgggggagtgtttaccagcgttggcaaactggtccatcagatcttcgggacagcctacggagtgctcttttccggcgtgagctggaccatgaagattgggatcggcgtcctgcttacgtggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacagaacaatataagtttcaggcggactcccctaaacggctgtctgccgctatcggcaaggcctgggaggagggggtctgcggcatcagaagcgctacccgcctcgaaaacattatgtggaaacagatctccaacgagctgaatcatattcttctggaaaacgacatgaagttcacggtggttgtgggagatgtcgccggcatcctcgcccaggggaaaaagatgattcggccgcaacccatggagtacaaatattcttggaaaagctggggaaaggctaagatcatcggcgcggacgtgcagaatacaacctttattatcgatgggcctaacacccccgaatgtcctgacgatcagagagcctggaatatttgggaggtggaggactacggattcggcatctttacaaccaacatttggctgaagctgcgcgattcctatacgcaggtctgcgaccaccggcttatgagcgctgccatcaaagattctaaggccgttcacgctgacatgggctactggatcgaatccgagaaaaatgaaacatggaagctcgccagagcgagcttcattgaggtgaagacctgtatctggcccaaatctcatacactgtggtccaacggggtgctggaaagcgagatgattatcccgaagatttatggaggccctatctctcaacacaattaccgccccgggtacttcacccagacagctggaccttggcatctcggcaaactggagcttgattttgacctgtgcgaagggaccacggtcgtggttgatgagcactgcggaaaccggggccccagcctcagaaccacaaccgtgacaggcaagatcattcacgaatggtgttgccggtcctgtaccctgcctcccctgcgcttcagaggggaggacggatgctggtatggcatggagatccggccggtcaaagaaaaggaggaaaatcttgtcaagagcatggtttctgccgggtccggagaggtggacagcttttccctcggcctgctgtgtatttctatcatgattgaagaggtcatgagaagccgctggtcccggaaaatgctcatgacggggacactggccgtgttccttctgctcatcatgggacagctgacctggaacgatctgattagactttgcatcatggttggcgctaatgcctctgaccgcatgggcatggggacaacctacctggcgctcatggctacctttaagatgagacctatgttcgccgtgggactgctctttcggcgcctgacaagcagagaggtccttctgctcacgatcggcctgtccctggtggcctctgtggaacttcccaacagcctggaggaactcggggatggactggctatgggcattatgatcctcaaactgcttaccgacttccaatcccatcagctgtgggccacactcctgagcctgacctttattaagacaaccttctctcttcactatgcttggaaaacgatggccatggtcctgtccatcgttagcctctttcccctgtgtctctctacaacctcccagaagaccacatggctgcctgtgcttctggggagcctgggatgcaagccgctcaccatgttcctgattgcggagaataaaatctggggccggcgctcttggccccttaacgaaggcatcatggccgtggggattgtctccatcctgctcagctccctgctcaagaacgatgtgcctctggctggaccccttattgccggcgggatgctgatcgcttgttacgttattagcggatctagcgccgacctgtccctcgagaaagccgctgaggtgtcttgggaagaggaagcggagcatagcggcgcctcccacaatatcctggtcgaagtgcaggatgacgggacaatgaagatcaaagatgaggagagagacgatacgcttaccattctgctcaaggctacactgctcgccgtttctggagtgtatcctctgagcatccccgccaccctttttgtctggtacttctggcagaagaagaagcagcggtccggcgtgctgtgggacacaccttctcccccggaagtcgagcgcgctgtgctggatgacggcatttatagaatcatgcagcgggggctcctgggacgcagccaggttggcgtgggggtcttccaagaaaacgtgtttcataccatgtggcacgttacgagaggagccgtgcttatgtaccagggcaaacggctggagccttcctgggcgagcgtcaagaaagacctcatttcttacgggggaggctggagactgcagggctcctggaataccggggaggaagtgcaagtgatcgctgttgagcccggaaagaaccctaaaaatgtccaaacagcccccggcaccttcaagacaccggaaggggaggtgggagccattgctctcgattttaagcctggcaccagcgggtctcccatcgtgaaccgcgaaggaaaaatcgtcggcctgtatggcaatggggtggttacaacgtccggaacctacgtgagcgccattgcgcaggctaaggcctcccaggagggccctcttcccgagatcgaagacgaggtcttccggaaaagaaacctgacaattatggatctgcaccccgggtctggaaagacccgccggtatctccctgccatcgtgagagaagctattaaacgcaagctgcggacccttatcctggccccgacaagagttgtggctagcgagatggccgaagcgctcaagggcatgcccatccgctaccaaacgaccgccgtcaaatccgagcatacagggaaggagattgtggacctgatgtgccacgctacctttacaatgcggctgctcagccctgttagagtgcccaattataacatgatcattatggatgaagcccatttcaccgacccttcttccatcgctgcccggggctacattagcacgcgcgtcggaatgggcgaggccgctgcgatctttatgacagccacaccccctgggtctgtggaggctttcccgcagagcaatgccgtgatccaggatgaggaaagagacattcccgagcggtcctggaactctggatatgagtggatcaccgattttcctggcaaaacagtctggttcgttcccagcattaagtccgggaatgacatcgccaactgtcttcgcaaaaatggaaagagagtgattcagctgtctcggaagacctttgatacagaataccagaaaaccaagaacaacgactgggactacgtggtcacgacagatatcagcgagatgggcgctaatttcagagccgaccgcgtgattgatcctcggagatgcctgaaacccgttatcctcaaggacgggccggaacgcgtgatcctggcgggccctatgcccgtcaccgtggcttccgccgcccagcggagaggacgcattggccggaaccacaataaagagggggatcagtatatctacatgggacagccccttaacaatgacgaggatcatgctcactggacagaagccaagatgctgctcgacaacattaatacccctgagggcatcattcccgcgctgttcgaacctgagagagaaaagagcgccgctatcgatggggagtatcgcctgagaggagaggcccggaaaacgtttgttgaactcatgcgcagaggcgaccttccggtgtggctgtcttacaaggtcgcttccgaggggttccaatatagcgatcggcgctggtgctttgacggcgaaagaaacaatcaggtgctggaggaaaacatggatgtcgagatctggaccaaagagggagaacggaagaaactcagaccccgctggctggacgcccggacatactccgaccctcttgctctgagagagttcaaggaatttgccgcgggccgccggtctgtgagcggggatctcattctggagatcggaaaactgccccagcacctcacccagagagcccaaaatgctcttgacaacctggttatgctgcataattccgaacagggcgggcgggcctatcgccacgctatggaggagctccctgatacaattgaaaccctgatgcttctggccctcatcgccgtgctgacaggaggcgtgaccctgttctttctctctggcagagggcttggaaagacgagcattggcctgctgtgtgtcatggcttccagcgttctcctgtggatggcgtctgtggagccccattggatcgccgcttccatcattcttgagttctttctgatggtgctcctgatcccggagcctgaccggcagcgcacaccccaggataaccaactggcctacgtcgtgattgggctccttttcatgatcctgaccgttgccgctaatgagatgggactgctcgaaaccacaaagaaagacctgggcattgggcacgtggccgtcggaaaccaccatcacgcggccatgcttgatgtggacctgcatcctgctagcgcctggaccctctacgctgtcgccacaacgatcattacccccatgatgagacacacaatcgagaacaccacagcgaatatctctctgaccgccattgctaaccaggccgctatcctgatgggcctcgataagggctggcctatttccaaaatggacatcggggtgccccttctggccctgggatgctatagccaggttaatccgctcacgctgaccgctgccgtgcttatgctggtcgcgcattacgccattatcggccctgggctccaagctaaggccacacgggaagctcagaaacgcaccgccgccggaatcatgaagaaccccacagtggatggcattgttgcgatcgacctggatcccgtggtctatgacgctaagtttgagaaacagctggggcagattatgctccttatcctgtgtacctctcaaattctgctcatgagaacgacatgggccctgtgcgaaagcatcacccttgctacaggacctctgaccaccctctgggagggctccccgggcaagttctggaatacaacgatcgccgtgtctatggccaacatttttcgggggagctacctggctggagccggcctggcgttctccctcatgaaaagccttgggggaggccgcagagggaccggagcccagggcgagacactgggcgaaaagtggaaacggcagctgaatcagctctccaagtctgagttcaacacctataagagaagcgggatcatggaagtggaccgctccgaggctaaagaaggactgaagcggggcgagacaaccaaacacgccgtttctagagggacggctaaacttcgctggtttgtcgagcggaatctggtgaaacccgaaggaaaggtgattgatctcggctgtgggagaggaggctggagctactattgcgccggcctgaagaaagtcacagaggttaaggggtacaccaaaggaggccctgggcacgaagaacccatccctatggcgacctacggatggaacctggtgaagctccattccggcaaagacgtgttctttattccccctgaaaagtgtgatacacttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaacgctggagcagatgcagcgcaagcacggcgggatgctcgtccggaaccccctgagcagaaattctacccatgagatgtactgggtgtcctgcggaacaggcaacattgttagcgccgtgaatatgacctctcgcatgctgctcaaccggtttacaatggctcacagaaaaccgacctatgaacgcgatgtcgacctgggggccggaacgagacacgtggctgtggagcctgaagtcgccaaccttgatatcattggccagcggatcgagaatattaagcatgaacacaaatccacctggcattacgacgaggataacccctataagacatgggcttaccacgggagctatgaggttaaaccctctggatccgccagctccatggtgaatggcgtggtcaagctgctcaccaagccttgggacgtgatccccatggttacacaaatcgcgatgaccgatacaacccctttcggccagcagcgcgtgtttaaagaaaaggtcgacacgagaacaccgaaagccaagcgggggaccgctcaaattatggaggtgaccgccaaatggctgtggggattccttagcagaaacaagaagccccggatctgtacacgcgaagagtttacgagaaaagttcggtctaatgctgccattggcgccgtgttcgtcgacgaaaaccagtggaatagcgcgaaggaggctgtggaggatgaacgcttttgggacctggttcataaagagagagaactccacaagcaggggaaatgcgcgacctgcgtgtacaacatgatgggaaagcgggagaagaaactgggcgagttcgggaaggccaaaggctcccgcgctatctggtacatgtggctgggagccagatttctcgagttcgaggctctgggcttcatgaatgaagatcactggttttctcgggagaacagcctttccggggtcgaaggagagggcctgcataagctcgggtatattctgcgcgacatctctaaaatccctggaggcaatatgtacgccgatgacacagcggggtgggataccagaattacagaggacgatcttcagaacgaagcccggatcaccgacattatggagcccgaacacgctctgctcgccaagagcatcttcaaactgacatatcaaaataaggtggtccgcgtgcagagacctgctaagaacggcaccgttatggatgtgatttcccggcgcgaccagagaggatctggccaggtcgggacgtacggactgaatacctttacaaacatggaggcccaactcatccggcagatggaaagcgagggcatcttctcccccagcgagctggaaaccccgaaccttgcggagagagtgctggattggctcgaaaaatatggggtggagcgcctgaagcggatggccatttctggagacgactgtgttgtgaaacctatcgatgacagatttgctacagcccttaccgctctgaatgatatgggcaaggtccgcaaagacattccccagtgggaaccttccaaggggtggaacgattggcagcaagtgcccttctgcagccatcactttcaccagctcatcatgaaggacggccgggagattgttgtgccttgtagaaatcaggatgagctggtcggacgcgcccgggtgtctcagggcgctgggtggtccctgagagaaacggcctgcctcggaaaaagctacgcgcaaatgtggcagctgatgtatttccatcgccgggaccttagactggccgctaacgccatctgttccgccgtccccgtggattggattccgacatctcgcaccacatggagcatccacgctcatcaccagtggatgaccacggaggacatgctctccgtttggaatcgggtgtggatcgaagagaacccttggatggaagataagacccatattagctcttggggcgacgtcccctacctggggaaaagagaggaccaatggtgcggatcccttatcggcctgacagcccgggcgacctgggctacaaatattcaggtggccatcaaccaggttagacgcctcattgggaatgagaactacctggattatatgaccagcatgaagcggtttaaaaatgaatctgaccccgagggcgccctgtggtga

SEQ ID NO: 18530 - RNA, 9879 nt, synthetic construct
  misc_feature 1..9879: note = derived and/or modified CDS sequence (opt5) from DENV-1__GQ868632__SS-prME
  source 1..9879: mol_type = other RNA
agcgtgaccatgctgctcatgctgatgcccaccgcccttgctttccacctgacgaccagaggaggggagcctcatatgatcgtctccaagcaggaacggggaaaatctctcctgtttaagaccagcgccggcgttaacatgtgcacccttatcgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaagggggttagctatgtgatgtgtacaggctctttcaaactcgagaaggaagtcgccgagacccagcacggaaccgtgctggttcagatcaagtacgagggcacagacgcgccgtgcaaaatccctttctccacccaagatgaaaagggggtgacacagaacggacggctgattacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaaaatcatcggcgctgacgtgcagaataccacctttattatcgatgggcctaacacacccgaatgtcctgacgagcagagagcgtggaatatttgggaggtcgaagattacggattcggcatctttaccacgaacatttggctgaagctgcgcgactcctatacacaggtttgcgatcaccggcttatgagcgccgctatcaaagactctaaggccgtgcacgccgatatgggctactggatcgagtccgaaaagaatgagacctggaagctcgctagagccagcttcattgaagtgaagacatgtatctggcccaaatctcataccctgtggtccaacggggtcctggagagcgagatgattatcccgaagatttatggaggccctatctctcaacacaattaccgccccgggtacttcacacagaccgcgggaccttggcatctcggcaaactggaacttgactttgatctgtgcgaggggacgaccgtggttgtggacgaacactgcggaaaccggggccccagcctcagaacaaccacagtcaccggcaagatcattcacgagtggtgttgccggtcctgtacgctgcctcccctgcgcttcagaggggaggatggatgctggtatggcatggaaatccggccggtgaaagagagagaagagaatcttgttaagagcatggtgtctgctgggtccggagaagtcgacagcttttccctcggcctgctgtgtatttctatcatgattgaggaggtgatgcgcagccggtggtccagaaagatgctcatgacagggaccctggccgttttccttctgctcatcatgggacagctgacatggaacgacctgattcgcctttgcatcatggtgggcgccaatgcttctgatagaatgggcatggggaccacctacctggccctcatggcgacatttaaaatgcggcctatgttcgctgtcggactgctctttcgcagactgacgagccgggaagtgcttctgctcaccatcggcctgtccctggtggcctctgtcgagcttcccaacagcctggaggaactcggggacggactggccatgggcattatgatcctcaagctgcttacagatttccaatcccatcagctgtgggctaccctcctgagcctgacatttattaaaaccacgttctctcttcactatgcctggaagacaatggctatggttctgtccatcgtgagcctctttcccctgtgtctctctaccacctcccagaaaacaacctggctgcctgtgcttctggggagcctgggatgcaagccgctcacaatgttcctgattgccgaaaataagatctggggccgcagatcttggccccttaacgagggcatcatggcggtcgggattgtgtccatcctgctcagctcctttctgaaaaacgacgttcctctcgccggacccctgattgctggcgggatgcttatcgcctgttacgtgattagcggatctagcgctgatctgtccctggagaaggccgccgaagtctcttgggaggaagaggctgaacatagcggcgcgtcccacaatatcctcgtggaggttcaggacgatgggacgatgaaaatcaaggacgaggaacgggatgacaccctgacaattcttctgaaagccaccctcctggctgtgtctggagtctatcctctcagcatccccgccacactgttcgtgtggtacttctggcaaaagaaaaagcagcgctccggcgtcctttgggataccccttctcccccggaggtggaaagagccgttctggacgatggcatttatcggatcatgcagcgcgggctgctcggaagaagccaggtgggcgtcggggtgtttcaagagaacgttttccatacgatgtggcacgtgacccggggagctgtcctgatgtaccagggcaagagacttgagccttcctgggccagcgtgaaaaaggacctgatttcttacgggggaggctggcgcctccagggctcctggaatacaggggaagaggtgcaggttatcgcggtcgaacccggcaagaaccctaagaatgtgcaaaccgctcccggcacatttaaaaccccggagggggaagtgggagccattgccctggacttcaagcctggcacaagcgggtctcccatcgtcaaccgggagggaaagatcgtgggcctctatggcaatggggttgtgacgacctccggaacatacgtcagcgctattgcccaggcgaaggcttcccaggagggccctctgcccgaaatcgaggatgaagtgtttagaaagcgcaaccttaccattatggacctgcaccccgggtctggaaaaacccggagatatctgcctgccatcgttcgcgaggccattaagcggaaactcagaacactgatccttgctccgacgcgcgtggtcgccagcgaaatggctgaggccctgaagggcatgcccatccggtaccaaaccacagcggtgaagtccgagcataccgggaaagaaattgttgatctcatgtgccacgccacattcaccatgagactgctgagccctgtgcgggtccccaattataacatgatcattatggacgaggctcattttacggatccttcttccatcgccgctcgcggctacattagcacaagagtgggaatgggcgaagccgccgctatcttcatgaccgcgacaccccctgggtctgtggaggcctttccgcagagcaatgctgtcatccaggacgaggaacgggatattcccgagcgctcctggaactctggatatgaatggatcacagacttccctggcaagaccgtttggtttgtgcccagcattaaatccgggaatgatatcgccaactgtctcagaaagaatggaaaacgggtgattcagctttctagaaagacattcgacaccgagtaccaaaagacgaaaaacaacgattgggactacgtcgtgacaaccgacatcagcgaaatgggcgccaatttccgcgctgatcgggttattgaccctagacgctgcctgaagcccgtgatcctgaaagatgggccggagcgggtcatcctcgccggccctatgcccgtgacagttgcgtccgctgcccagagacgcggacggattggcagaaaccacaataaggagggggaccagtatatctacatgggacagcccctgaacaatgatgaagaccatgcccactggaccgaggctaaaatgcttctggataacattaatacgcctgaaggcatcattcccgccctctttgagcctgaacgcgagaaaagcgcggccatcgacggggagtatagactgcggggagaagctcgcaagaccttcgtggagctgatgagacggggcgatctcccggtctggctttcttacaaagtggcctccgaagggtttcaatatagcgaccgcagatggtgcttcgatggcgagcggaacaatcaggtcctggaagagaacatggacgtggagatctggacaaaggaaggagagcgcaaaaagctgcgcccccggtggctcgatgctagaacctactccgaccctctggcccttcgcgaatttaaagagttcgctgccggccggagatctgttagcggggacctgattctcgaaatcggaaagctgccccagcacctgacacagcgggcgcaaaatgccctcgataaccttgtgatgctgcataattccgagcagggcgggcgcgcttatagacacgccatggaggaactgcctgacaccattgagacactcatgctgcttgctctgatcgccgtgctcaccggaggcgtcacgctgtttttcctgtctggccgggggctcggaaaaacaagcattggccttctgtgtgttatggcctccagcgtgctgctctggatggcttctgtggaaccccattggatcgcggcctccatcattctggagtttttccttatggtcctgctcatcccggagcctgatcgccagagaacaccccaggacaaccaactggcttacgtggttattgggctgctctttatgatccttaccgtggccgccaatgaaatgggactgctggagacaaccaagaaggatctcggcattgggcacgtcgctgtgggaaaccaccatcacgccgcgatgctggacgtcgatcttcatcctgccagcgcttggacactgtacgccgtggctacgaccatcattacacccatgatgcggcacaccatcgaaaacacaaccgccaatatctctctcacggcgattgccaaccaggctgccatcctgatgggcctggacaaaggctggcctatttccaagatggatatcggggttcccctccttgctctgggatgctatagccaggtgaatccgctgaccctcacagccgctgtcctgatgcttgtggcccattacgcgattatcggccctgggctgcaagccaaagctacccgcgaggcccagaagagaacagctgccggaatcatgaaaaaccccaccgttgacggcattgtggccatcgatctcgaccccgtcgtgtatgatgcgaagttcgaaaagcagctggggcagattatgctgctcatcctttgtacgtctcaaattctgctgatgcggacaacctgggctctctgcgagagcatcacactggccaccggacctcttaccacactgtgggagggctccccgggcaaattttggaatacgaccatcgctgtgtctatggccaacattttccgcgggagctacctcgccggagctggcctggccttctccctgatgaaaagcctcgggggaggcagacgggggacaggagcgcagggcgaaacccttggcgagaaatggaagagacagctgaatcagctgtccaaatctgaatttaacacatataagcgcagcgggatcatggaggttgaccggtccgaagccaaggagggactcaaaagaggcgagaccacgaagcacgctgtctctcgcgggacagccaaactgcggtggttcgtggaaagaaatcttgtgaagcccgagggaaaagtcattgacctgggctgtgggcgcggaggctggagctactattgcgctggcctcaagaaggttaccgaagtgaaagggtacaccaagggaggccctgggcacgaggaacccatccctatggccacatacggatggaacctggtgaaactgcattccggcaaggatgtctttttcattccccctgagaaatgtgacaccctcctttgcgatatcggggagtctagcccgaatcccacaattgaagagggacggacgctgagagtgctgaagatggttgaaccttggctccgcggcaaccaattttgtatcaaaatcctgaatccctatatgccttccgtggtcgagacccttgagcagatgcagcggaagcacggcgggatgctggtgagaaaccccctcagccgcaattctacacatgaaatgtactgggtttcctgcggaaccggcaacattgtgagcgcggtcaatatgacatctcggatgctgctgaacagattcaccatggcccaccgcaagccgacgtatgagagagacgtggatctcggggctggaacccggcacgtggccgtcgaacctgaggttgctaacctggacatcattggccagcgcatcgaaaatattaaacatgagcacaagtccacatggcattacgatgaggacaacccctataaaacctgggcctaccacgggagctatgaagtgaagccctctggatccgctagctccatggtgaatggcgtcgtgaaacttctgacaaagccttgggatgttatccccatggtgacccaaatcgccatgacagacaccacgccttttggccagcagagagtcttcaaggagaaagtggatacacggaccccgaaggcgaaaagagggaccgcccaaattatggaagttacagctaagtggctctggggatttctgagccggaacaaaaagccccgcatctgtacgagagaggagttcacccggaaggtgcgctctaatgccgctattggcgccgtctttgtggacgagaaccagtggaatagcgccaaagaggcggttgaagacgagagattctgggatcttgtgcataaggaacgggagctgcacaaacaggggaagtgcgctacatgcgtctacaacatgatgggaaaacgcgaaaagaagctcggcgagtttgggaaagccaagggctccagagccatctggtacatgtggctgggagctcggttcctggagttcgaagccctcggctttatgaatgaggaccactggttctctcgcgaaaacagcctgtccggggtggagggagagggccttcataaactggggtatattctcagagatatctctaagatccctggaggcaatatgtacgctgacgataccgccgggtgggacacacggattaccgaagatgacctgcagaacgaggcgcgcatcacagatattatggaacccgagcacgcccttctggctaaaagcatctttaagctcacctatcaaaataaagtcgtgagagttcagcggcctgccaagaacggcacggtgatggacgtcatttcccgcagagatcagcggggatctggccaggtggggacctacggactgaatacattcaccaacatggaagctcaactgatcagacagatggagagcgagggcatcttttcccccagcgaactcgagacaccgaacctggccgaacgcgtgcttgactggctggagaagtatggggttgaacggctcaaaagaatggcgatttctggagatgactgtgtggtcaagcctatcgacgatcgcttcgccaccgctctgacggcccttaatgacatgggcaaagtgcggaaggatattccccagtgggagccttccaaagggtggaacgactggcagcaagttcccttttgcagccatcacttccaccagctgatcatgaaggatggcagagagattgtggtcccttgtcgcaatcaggacgaactcgtgggacgggctagagtctctcagggcgccgggtggtccctgcgcgagacagcttgcctgggaaagagctacgcccaaatgtggcagctcatgtattttcatcggagagatctgcgccttgcggccaacgctatctgttccgccgtgcccgttgactggattccgacctctcggacaacctggagcatccacgcccatcaccagtggatgacgaccgaagatatgctgtccgtgtggaatagagtctggatcgaggaaaacccttggatggaggacaaaacacatattagctcttggggcgatgtgccctacctcgggaagcgggaggaccaatggtgcggatccctgatcggccttaccgctagagccacatgggcgaccaatattcaggttgctatcaaccaggtgcgccggctgattgggaatgaaaactacctcgactatatgacaagcatgaaaagattcaagaatgagtctgatcccgaaggcgccctgtggtga

SEQ ID NO: 18531 - RNA, 9879 nt, synthetic construct
  misc_feature 1..9879: note = derived and/or modified CDS sequence (opt5) from DENV-1__GQ868633__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgaggctaccaaacacgccgtttctagagggcccgctaaacttcgctggtttgtcgagcggaatctggtgaaccctgaaggaaaagtgattgatctcggctgtgggagaggaggctggagctactattgcgccggcctgaagaaggtcacggaggttaaagggtacacaaagggaggccccgggcacgaagaacctatccccatggcgacctacggatggaatctggtgaaactccattccggcaaggacgtgttctttattcctccggaaaaatgtgatacccttctgtgcgacatcggggagtctagccccaaccctacaattgaggaaggacgcaccctgcgggtcctcaagatggtggagccctggctgagaggcaatcaattctgtatcaaaatccttaacccttatatgccctccgttgtggaaacactggagcagatgcagcgcaagcacggcgggatgctcgtccggaatccgctgagcagaaactctacgcatgagatgtactgggtgtcctgcggaaccggcaatattgttagcgccgtgaacatgacatctcgcatgctgctcaaccggtttaccatggctcacagaaagcctacatatgaacgcgatgtcgacctgggggccggaaccagacacgtggctgtggagcccgaagtcgccaatcttgatatcattggccagcggatcgagaacattaaacatgaacacaagtccacgtggcattacgacgaggataatccctataaaacctgggcttaccacgggagctatgaggttaagccttctggatccgccagctccatggtgaacggcgtggtcaaactgctcacaaagccctgggacgtgatccctatggttacccaaatcgcgatgacagataccacaccgttcggccagcagcgcgtgtttaaggaaaaagtcgacaccagaacgcccaaggccaaacgggggacagctcaaattatggaggtgaccgccaagtggctgtggggattccttagcagaaataaaaagcctcggatctgtacccgcgaagagtttacaagaaaggttcggtctaacgctgccattggcgccgtgttcgtcgacgaaaatcagtggaacagcgcgaaagaggctgtggaggatgaacgcttttgggacctggttcataaggagagagaactccacaaacaggggaagtgcgccacgtgcgtgtacaatatgatgggaaaacgggagaagaagctgggcgagttcgggaaagccaagggctcccgcgctatctggtacatgtggctgggagccagatttctcgagttcgaggctctgggcttcatgaacgaagatcactgggtctctcgggagaatagcctttccggggtggaaggagagggcctgcataaactcgggtatattctgcgcgacatctctaagatccccggaggcaacatgtacgccgatgacaccgcggggtgggatacaagaattaccgaggacgatcttcagaatgaagcccggatcacagacattatggagcctgaacacgctctgctcgccaaaagcatctttaagctgacctatcaaaacaaagtcgtgcgcgttcagagacccgctaagaatggcacagtgatggatgtcatttcccggcgcgaccagagaggatctggccaggtggggacctacggactgaacacgttcaccaacatggaggcccaactcatccggcagatggaaagcgagggcatcttttccccgagcgagctggaaacacctaatcttgcggagagagtgctggattggctcgaaaagtatggggttgagcgcctgaaacggatggccatttctggagacgactgtgtggtcaagcccatcgatgacagattcgctaccgcccttacagctctgaacgatatgggcaaagtgcgcaaggacattcctcagtgggaaccctccaaagggtggaatgattggcagcaagttcctttttggagccatcacttccaccagctcatcatgaaggacggccgggagattgtggtcccctgcagaaaccaggatgagctggtgggacgcgcccgggtctctcagggcgctgggtggtccctgagagaaaccgcctgtctcggaaagagctacgcgcaaatgtggcagctgatgtattttcatcgccgggaccttagactggccgctaatgccatctgctccgccgtgccggttgattggattcctacgtctcgcacaacctggagcatccacgctcatcaccagtggatgacaaccgaggacatgctctccgtgtggaaccgggtctggatcgaagagaatccctggatggaagataaaacgcatattagctcttggggcgacgtgccctacctggggaagagagaggaccaatggtgtggatcccttatcggcctgaccgcccgggcgacatgggctaccaacattcaggttgccatcaatcaggtgagacgcctcattgggaacgagaattacctggattatatgacaagcatgaaacggttcaagaacgaatctgaccctgagggcgccctgtggtga

SEQ ID NO: 18532 - RNA, 9879 nt, synthetic construct
  misc_feature 1..9879: note = derived and/or modified CDS sequence (opt5) from DENV-1__GU131919__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaagtctctcctgtttaagaccagcgccggcgttaacatgtgcacccttatcgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttcctgacccaagatgaaaagggggttacacagaacggacggcttattacggctaatcccatcgtgaccgacaaagagaagcctgtcaacattgaagccgagccgccctttggcgagtcctatatcgtgattggggccggagaaaaagctctcaagctgagctggttcaagaaaggctctagcatcgggaagatgtttgaggccacagctagaggcgcccgccggatggcgatcctgggagataccgcctgggacttcggctccattgggggagtgtttacatctgttggcaaactcatccatcagattttcgggaccgcttacggagtcctgtttagcggcgtgtcctggacgatgaagatcgggattggcgtgcttctgacctggctcggactgaatagcagatctacatccctgagcatgacctgtatcgccgtcggccttgtgacactctacctgggggttatggtgcaggctgattctggatgcgtcattaactggaaaggccgcgaactgaagtgtgggtccggaatcttcgtgaccaatgaggttcacacatggaccgaacaatataagtttcaggccgacagccctaaacggctctccgcggccatcggcaaggcttgggaggagggggtgtgcggcattagatctgccacgcgcctggaaaacatcatgtggaaacagattagcaacgagcttaatcatatcctgctcgaaaacgacatgaagttcacagtcgtggttggagatgtggctggcattctggcccaggggaaaaagatgatccggccgcaacccatggagtacaaatattcctggaagtcttggggaaaggccaaaatcattggcgctgacgtccagaataccacctttatcattgatgggcctaacacacccgaatgtcctgacgatcagagagcgtggaatatctgggaggtggaggactacggattcggcatttttaccacgaacatctggctgaaacttcgcgatagctatacacaggtgtgcgaccaccggctcatgtccgccgctatcaaagatagcaaggccgtccacgccgacatgggctactggattgaatctgagaaaaatgaaacctggaagctggctagagcctccttcatcgaggttaagacatgtatttggcccaaaagccataccctgtggtctaacggggtgctcgaatccgagatgatcattccgaagatctatggaggccctatcagccaacacaattaccgccccgggtacttcacacagaccgcgggaccttggcatctgggcaaacttgagctggattttgacctctgcgaagggacgaccgtggtcgtggatgagcactgcggaaaccggggcccctctctgagaacaaccacagttaccggcaagattatccacgaatggtgttgccggagctgtacgctgcctccccttcgcttcagaggggaggacggatgctggtatggcatggagattcggccggtgaaagaaaaggaggaaaatctcgtcaagtccatggtgagcgctgggtctggagaggttgactcctttagcctgggcctgctctgtatctccattatgatcgaagaggtgatgagatctcgctggagccggaaaatgctgatgacagggacccttgccgtcttcctgctcctgattatgggacagctgacatggaacgatcttatcagactgtgcatcatggtgggcgccaatgcttgtgaccgcatgggcatggggaccacctacctcgccctgatggcgacatttaagatgagacctatgttcgctgttggactcctgtttcggcgccttacgtccagagaggtgctgctcctgaccattggcctgtctcttgtcgccagcgtggaactgcccaactccctcgaggaactgggggatggactcgccatgggcatcatgattctgaaacttctgacagacttccaatcttatcagctctgggctaccctgctgagccttacatttatcaagaccacgttctccctgcattacgcctggaaaacaatggctatggtgctcagcattgtctctctgtttcccctctgcctgtccaccaccagccagaagacaacctggcttcctgttctgctggggtctctcggatgtaagccgctgacaatgttccttatcgccgagaataaaatctggggccggcgctcctggcccctgaacgaaggcattatggcggtggggatcgtgagcattctcctgtcttccctcctgaagaacgatgtccctcttgccggacccctgatcgctggcgggatgctgattgcctgctatgtgatcagcggatccagcgctgacctctctctggagaaagccgccgaggttagctgggaagaggaagctgagcactccggcgcgtctcataatatccttgtggaagtccaggatgacgggacgatgaagattaaagatgaggagagagacgataccctgacaatcctcctgaaggccaccctcctggctgtgagcggagtttaccctctttccattcccgccacactgtttgtgtggtatttctggcagaagaagaagcagcggtctggcgtcctgtgggacacccctagccctcccgaagtggagcgcgccgtcctcgatgacggcatctacagaattatgcagcgggggctgcttggacgctcccaggtgggcgttggggtgttccaagaaaacgtctttcacacgatgtggcatgtgaccagaggagctgttctgatgtaccagggcaaacggctcgagccctcttgggccagcgtgaagaaagacctgatctcctatgggggaggctggagactccagggcagctggaatacaggggaggaagtccaggtgattgcggtggagcccggaaagaaccctaaaaatgttcaaaccgctcccggcacattcaagaccccggaaggggaggtcggagccatcgccctggattttaagcctggcacatctgggtcccccatcgtgaaccgcgaaggaaaaattgtgggcctttacggcaatggggtcgtgacgaccagcggaacatatgtttctgctatcgcccaggcgaaggcttcccaggagggccctctgcccgagattgaagacgaggtgttccggaaaagaaacctgaccatcatggatctccaccccgggagcggaaagacccgccggtacctgcctgccattgtcagagaagccatcaaacgcaaacttcggacactgatcctcgctccgacgagagtggttgcctccgagatggctgaagccctgaagggcatgcccattcgctatcaaaccacagcggtgaaatctgagcacaccgggaaggagatcgtcgacctgatgtgtcatgccacatttaccatgcggctccttagccctgtgagagttcccaattacaacatgattatcatggatgaagctcacttcacggacccttccagcattgccgctcggggctatatctctacacgcgtgggaatgggcgaggccgccgctatctttatgaccgcgacaccccctgggtccgtcgaagccttcccgcagagcaatgctgtgattcaggatgaggaaagagacatccccgagcggtcttggaacagcggatacgagtggattacagattttcctggcaaaaccgtgtggttcgtcccctccatcaagtctgggaatgacattgccaactgcctgcgcaaaaatggaaagagagttatccagctgagccggaagacatttgataccgaataccagaagacgaagaacaacgactgggactatgtggtgacaaccgatatttccgagatgggcgccaatttcagagctgaccgcgtcatcgatcctcggagatgcctcaaacccgtgatcctgaaggacgggccggaacgcgttattcttgccggccctatgcccgtgacagtcgcgtctgctgcccagcggagaggacgcatcggccggaaccataataaagagggggatcagtacatttatatgggacagcccctgaacaatgacgaggatcacgcccattggaccgaagctaagatgctcctggacaacatcaatacgcctgagggcattatccccgccctgttcgaacctgagagagaaaagagcgcggccatcgatggggagtaccgcctcagaggagaggctcggaaaacctttgtggaacttatgcgcagaggcgacctgccggtttggctgtcctataaggtggccagcgaggggttccaatactctgatcggcgctggtgttttgacggcgaaagaaacaatcaggtcctcgaggaaaacatggatgtggagatttggacaaaagagggagaacggaagaaactgagaccccgctggcttgacgctcggacctattccgaccctctggccctcagagagttcaaggaatttgctgccggccgccggagcgtctccggggatctgatcctggagattggaaaactcccccagcaccttacacagagagcgcaaaatgccctggacaacctggtgatgctccacaattctgaacagggcgggcgggcttaccgccatgccatggaggagctgcctgataccatcgaaacacttatgctgctcgctctgattgccgttctgaccggaggcgtgacgctgttctttcttagcggcagagggctgggaaagacatccatcggcctgctctgcgtgatggcctctagcgtcctgctttggatggcttccgttgagccccactggatcgcggccagcattatcctggagttctttctcatggtgctgctgattccggagcctgaccggcagcgcacaccccaagataaccaactcgcttacgtggtcatcgggcttctgttcatgattctgaccgtggccgccaatgagatgggactcctggaaaccaccaagaaagaccttggcatcgggcatgttgctgtgggaaaccaccaccatgccgcgatgctggatgtcgacctccaccctgcctctgcttggacactgtatgccgtggctacgaccattatcacacccatgatgagacataccatcgagaacacaaccgccaatatttccctgacggcgatcgccaaccaggctgccattctcatgggccttgataagggctggcctatcagcaaaatggacattggggtccccctgctggctctcggatgttactctcaggtgaatccgctgacccttacagccgctgttctgatgctcgtggcccactatgcgatcatcggccctgggctgcaagccaaggctacccgggaagcccagaaacgcacagctgccggaattatgaagaaccccaccgtcgatggcatcgtggccattgacctggatcccgttgtgtacgacgcgaagtttgagaaacagctcgggcagatcatgcttctgattctgtgcacgtcccaaatcctcctgatgagaacaacctgggctctttgtgaaagcatcacactggccaccggacctctcaccacactgtgggagggctctccgggcaagttctggaatacgaccattgctgtcagcatggccaacatctttcgggggtcctatctggccggagctggcctcgccttctctcttatgaaaagcctcgggggaggccgcagagggacaggagcgcagggcgagaccctgggcgaaaagtggaaacggcagctcaatcagctgtccaagagcgagttcaacacatacaagagatccgggattatggaagtggaccgctctgaggccaaagaaggacttaagcggggcgagaccacgaaacatgctgtgagcagagggacagccaagctgcgctggtttgttgagcggaatctcgtcaaacccgaaggaaaggtgatcgatctgggctgcgggagaggaggctggtcctattactgtgctggcctgaagaaagtgaccgaggtcaaggggtacaccaaaggaggccctgggcacgaagaacccattcctatggccacatatggatggaacctcgttaaacttcactctggcaaagacgtgttctttattccccctgaaaagtgcgataccctgctgtgtgacatcggggagagctccccgaatcccacaatcgaggaaggacgcacgctccgggtgctgaaaatggtcgagccttggcttagaggcaaccaattctgcatcaagattctgaatccctacatgccttctgtggttgaaaccctcgagcagatgcagcgcaagcatggcgggatgctggtgcggaaccccctgagcagaaattccacacacgagatgtattgggtcagctgtggaaccggcaacatcgtgtctgcggttaatatgacatcccgcatgctcctgaaccggtttaccatggcccatagaaaaccgacgtacgaacgcgatgtggaccttggggctggaaccagacacgtcgccgtggagcctgaagtggctaacctggatattatcggccagcggattgagaatatcaagcacgaacataaaagcacatggcactatgacgaggataacccctacaagacctgggcctatcatgggtcttacgaggtcaaaccctccggaagcgcttcttccatggttaatggcgtggtgaagctcctgacaaagccttgggacgtcatccccatggtgacccaaattgccatgacagataccacgcctttcggccagcagcgcgtttttaaagaaaaggtggacacaagaaccccgaaagcgaagcgggggaccgcccaaatcatggaggtcacagctaaatggctttggggattcctgagcagaaacaagaagccccggatttgcacgcgcgaagagtttaccagaaaagtgcggtccaatgccgctatcggcgccgttttcgtggacgaaaaccagtggaatagcgccaaggaggcggtcgaggatgaacgcttttgggacctcgtgcacagagagcgggaactgcataaacaggggaagtgcgctacatgtgtttacaacatgatgggaaaacgcgagaagaagctgggcgagttcgggaaagccaagggctctagagccatttggtatatgtggctcggagctcggtttctggagttcgaggcccttggcttcatgaatgaagatcactggtttagccgcgagaactccctgtctggggtggaaggagagggcctccacaaactggggtacatccttagagacatcagcaagattcctggaggcaatatgtatgctgatgacaccgccgggtgggatacacggatcaccgaggacgatctgcagaacgaagcgcgcattacagacatcatggagcccgaacatgccctcctggctaaatccattttcaagctgacctaccaaaataaagtcgtgagagtccagcggcctgccaagaacggcacggtgatggatgttatctctcgcagagaccagcggggaagcggccaggtggggacctatggactcaatacatttaccaacatggaggctcaactgatcagacagatggaatccgagggcattttctctcccagcgagcttgaaacaccgaacctggccgagcgcgtcctcgattggctggaaaagtacggggtggagcggcttaaaagaatggcgatctccggagacgactgcgtggttaagcctattgatgaccgctttgccaccgctctgacggccctcaatgatatgggcaaagtgcggaaggacatcccccagtgggaacctagcaaagggtggaacgattggcagcaagtccccttctgttctcaccattttcaccagctgattatgaaggacggcagagagatcgtggttccttgccgcaatcaggatgagctggtgggacgggctagagtctcccagggcgccgggtggagcctccgcgaaacagcttgtctgggaaagtcttatgcccaaatgtggcagcttatgtacttccaccggagagacctgcgcctcgcggccaacgctatttgctccgccgtgcccgtcgattggatcccgaccagccggacaacctggtccatccatgcccaccatcagtggatgacgaccgaggacatgctgtctgtgtggaatagagtttggattgaagagaacccttggatggaagataaaacacacatcagctcctggggcgacgtgccctaccttgggaagcgggaggaccaatggtgtggaagcctgattggcctcaccgctagagccacatgggcgaccaatatccaggtcgctattaaccaggtgcgccggctgatcgggaatgagaactatctggattacatgacatctatgaaaagatttaagaatgaatccgaccccgagggcgccctctggtga

SEQ ID NO: 18533 - RNA, 9879 nt, synthetic construct
  misc_feature 1..9879: note = derived and/or modified CDS sequence (opt5) from DENV-1__GU131920__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagagcaggacgctaacttcgtgtgccggcgcacatttgtggatagaggctggggcaatgggtgtggactcttcggcaaagggtctctgatcacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacagagagaaacctgtcaacattgaagccgagcccccctttggcgagagctatatcgtgattggggccggagaaaaggctcttaaactctcttggttcaagaagggcagctccatcgggaaaatgtttgaggccacagctcgcggcgcccggagaatggcgatcctgggagataccgcctgggacttcggctctattgggggagtgtttacaagcgttggcaagctggtccatcagatcttcgggaccgcttacggagtgctcttttccggcgtgagctggacgatgaaaattgggatcggcgtcctgcttacctggctgggactcaattctcgctccacaagcctgtctatgacctgtattgccgtgggcctggttacactttacctcggggtgatggtccaggctgattccggatgcgtgatcaactggaagggccgggaactgaaatgtgggagcggaattttcgttaccaatgaggtgcacacatggaccgaacaatataagtttcaggccgactcccctaagagactgtctgcggccatcggcaaagcttgggaggagggggtctgcggcatccgcagcgccacgcggctcgaaaacattatgtggaagcagatctccaacgagctgaatcatattcttctggaaaacgacatgaaattcacagtggttgtgggagatgtcgctggcatcctcgcccaggggaagaaaatgattagaccgcaacccatggagtacaagtattcttggaaaagctggggaaaggccaagatcatcggcgctgacgtgcagaataccacctttattatcgatgggcctaacacacccgaatgtcctgacgatcagcgcgcgtggaatatttgggaggtggaggactacggattcggcatctttaccacgaacatttggctgaaactgcgggattcctatacacaggtctgcgaccacagacttatgagcgccgctatcaaggattctaaagccgttcacgccgacatgggctactggatcgaatccgagaagaatgaaacctggaaactcgctcgcgccagcttcattgaggtgaagacatgtatctggcccaagtctcataccctgtggtccaacggggtgctggaaagcgagatgattatcccgaaaatttatggaggccctatctctcaacacaattaccggcccgggtacttcacacagaccgcgggaccttggcatctcggcaagctggagcttgattttgacctgtgcgaagggacgaccgtcgtggttgatgagcactgcggaaacagaggccccagcctccggacaaccacagtgaccggcaaaatcattcacgaatggtgttgccgctcctgtacgctgcctcccctgagattccggggggaggacggatgctggtatggcatggagatcagaccggtcaaggaaaaagaggaaaatcttgtgaagagcatggtttctgctgggtccggagaggtggacagcttttccctcggcctgctgtgtatttctatcatgattgaagaggtcatgcgcagccggtggtccagaaagatgctcatgacagggaccctggccgtgttccttctgctcatcatgggacagctgacatggaacgatctgattcgcctttgcatcatggttggcgccaatgcttctgacagaatgggcatggggaccacctacctggccctcatggcgacatttaaaatgcggcctatgttcgctgtgggactgctctttcgcagactgacgagccgggaggtccttctgctcaccatcggcctgtccctggtggcctctgtggaacttcccaacagcctggaggaactcggggatggactggccatgggcattatgatcctcaagctgcttacagacttccaatcccatcagctgtgggctaccctcctgagcctgacatttattaaaaccacgttctctcttcactatgcctggaagacaatggctatggtcctgtccatcgttagcctctttcccctgtgtctctctaccacctcccagaaaacaacctggctgcctgtgcttctggggagcctgggatgcaagccgctcacaatgttcctgattgccgagaataagatctggggccgcagatcttggccccttaacgaaggcatcatggcggtggggattgtctccatcctgctcagctccctgctcaaaaacgatgtgcctctggccggaccccttattgctggcgggatgctgatcgcctgttacgttattagcggatctagcgctgacctgtccctcgagaaggccgccgaggtgtcttgggaagaggaagctgagcatagcggcgcgtcccacaatatcctggtcgaagtgcaggatgacgggacgatgaaaatcaaggatgaggagcgggacgatacccttacaattctgctcaaagccaccctgctcgctgtttctggagtgtatcctctgagcatccccgccacactttttgtctggtacttctggcaaaagaaaaagcagcgctccggcgtgctgtgggacaccccttctcccccggaagtcgagagagccgtgctggatgacggcatttatcggatcatgcagcgcgggctcctgggaagaagccaggttggcgtgggggtcttccaagaaaacgtgtttcatacgatgtggcacgttacccggggagctgtgcttatgtaccagggcaagagactggagccttcctgggccagcgtcaaaaaggacctcatttcttacgggggaggctggcgcctgcagggctcctggaatacaggggaggaagtgcaggtgatcgcggttgagcccggaaaaaaccctaagaatgtccaaaccgctcccggcacattcaaaaccccggaaggggaggtgggagccattgccctcgattttaagcctggcacaagcgggtctcccatcgtgaaccgggaaggaaagatcgtcggcctgtatggcaatggggtggttacgacctccggaacatacgtgagcgctattgcccaggcgaaagcttcccaggagggccctcttcccgagatcgaagacgaggtcttcagaaagcgcaacctgaccattatggatctgcaccccgggtctggaaaaacccggagatatctccctgccatcgtgcgcgaagccattaagcggagactgcgcacacttatcctggctccgacgcgggttgtggccagcgagatggctgaagccctcaaaggcatgcccatcagataccaaaccacagcggtcaagtccgagcataccgggaaggagattgtggacctgatgtgccacgccacatttaccatgcggctgctcagccctgttcgcgtgcccaattataacatgatcattatggatgaagctcatttcacggacccttcttccatcgccgctagaggctacattagcacacgggtcggaatgggcgaggccgccgctatctttatgaccgcgaccccccctgggtctgtggaagccttcccgcagagcaatgctgtgatccaggatgaggaacgcgacattcccgagagatcctggaactctggatatgagtggatcacagattttcctggcaaaaccgtctggttcgttcccagcattaagtccgggaatgacatcgccaactgtcttcggaaaaatggaaagagagtgattcagctgtctcgcaaaacatttgataccgaataccaaaagacgaagaacaacgactgggactacgtggtcacaaccgatatcagcgagatgggcgccaatttccgggctgacagagtgattgatcctcgccggtgcctgaaacccgttatcctcaaggacgggccggaaagagtgatcctggccggccctatgcccgtcacagtggcgtccgctgcccagcgccggggaagaattggccgcaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaaaagcgcggccatcgatggggagtatcggctgcgcggagaggctagaaagacctttgttgaactcatgcggcgcggcgaccttccggtgtggctgtcttacaaggtcgcctccgaggggttccaatatagcgatagacggtggtgctttgacggcgaaagaaacaatcaggtgctggaggaaaacatggatgtcgagatctggacaaaagagggagaacgcaagaaactccggcccagatggctggacgctcgcacctactccgaccctcttgccctgcgggagttcaaggaatttgctgccggcagacggtctgtgagcggggatctcattctggagatcggaaaactgccccagcacctcacacagcgcgcgcaaaatgcccttgacaacctggttatgctgcataattccgaacagggcgggagagcttatcggcacgccatggaggagctccctgataccattgaaacactgatgcttctggctctcatcgccgtgctgaccggaggcgtgacgctgttctttctctctggccgcgggcttggaaagacaagcattggcctgctgtgtgtcatggcctccagcgttctcctgtggatggcttctgtggagccccattggatcgcggcctccatcattcttgaattctttctgatggtgctcctgatcccggagcctgacagacagcggaccccccaggataaccaactggcttacgtcgtgattgggctccttttcatgatcctgaccgttgccgccaatgagatgggactgctcgaaacaaccaaaaaggacctgggcattgggcacgtggctgtcggaaaccaccatcacgccgcgatgcttgatgtggacctgcatcctgccagcgcttggacactctacgccgtcgctacgaccatcattacacccatgatgcgccacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctaccagagaagcccagaaacggacagctgccggaatcatgaagaaccccaccgtggatggcattgttgccatcgacctggatcccgtggtctatgacgcgaaatttgagaagcagctggggcagattatgctccttatcctgtgtacgtctcaaattctgctcatgcgcacaacctgggctctgtgcgaaagcatcacacttgccaccggacctctgaccacactctgggagggctccccgggcaagttctggaatacgaccatcgctgtgtctatggccaacatttttagagggagctacctggccggagctggcctggccttctccctcatgaaaagccttgggggaggccggagagggacaggagcgcagggcgagaccctgggcgaaaagtggaaacgccagctgaatcagctctccaagtctgagttcaacacatataaacggagcgggatcatggaagtggacagatccgaggccaaggaaggactgaagcgcggcgagaccacgaaacacgctgtttctcgggggacagccaagcttagatggtttgtcgagcgcaatctggtgaaacccgaaggaaaggtgattgatctcggctgtgggcggggaggctggagctactattgcgctggcctgaaaaaggtcaccgaggttaaggggtacaccaaaggaggccctgggcacgaagagcccatccctatggccacatacggatggaacctggtgaagctccattccggcaaagacgtgttctttattccccctgaaaagtgtgatacccttctgtgcgacatcggggagtctagcccgaatcccacaattgaggaaggaagaacgctgcgcgtcctcaaaatggtggagccttggctgcggggcaaccaattctgtatcaagatccttaatccctatatgccttccgttgtggaaaccctggagcagatgcagagaaaacacggcgggatgctcgtccgcaaccccctgagccggaattctacacatgagatgtactgggtgtcctgcggaaccggcaacattgttagcgcggtgaatatgacatctagaatgctgctcaaccgctttaccatggcccacagaaagccgacgtatgaacgggatgtcgacctgggggctggaacccgccacgtggccgtggagcctgaagtcgctaaccttgatatcattggccagagaatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaaaccttgggacgtgatccccatggttacccaaatcgccatgacagataccacgcctttcggccagcagcgggtgtttaaggaaaaggtcgacacaagaaccccgaaagcgaagcgggggaccgcccaaattatggaggtgacagctaaatggctgtggggattccttagccgcaacaagaaacccagaatctgtacgcgggaagagtttacccgcaaggttagatctaatgccgctattggcgccgtgttcgtcgacgaaaaccagtggaatagcgccaaggaggcggtggaggatgaacggttttgggacctggttcataaagagcgcgaactccacaagcaggggaaatgcgctacatgcgtgtacaacatgatgggaaagagagagaaaaagctgggcgaattcgggaaggccaaaggctcccgggccatctggtacatgtggctgggagctcgctttctcgagttcgaggccctgggcttcatgaatgaagatcactggttttctagagagaacagcctttccggggtcgaaggagagggcctgcataagctcgggtatattctgcgggacatctctaaaatccctggaggcaatatgtacgctgatgacaccgccgggtgggatacacgcattaccgaggacgatcttcagaacgaagcgagaatcacagacattatggagcccgaacacgccctgctcgctaagagcatcttcaaactgacctatcaaaataaggtggtccgggtgcagcgccctgccaaaaacggcacggttatggatgtgatttccagacgggaccagagaggatctggccaggtcgggacctacggactgaatacatttaccaacatggaggctcaactcatccgccagatggaaagcgagggcatcttctcccccagcgagctggaaacaccgaaccttgccgagcgggtgctggattggctcgaaaagtatggggtggagagactgaagcgcatggcgatttctggagacgactgtgttgtgaaacctatcgatgaccggtttgccaccgctcttacggccctgaatgatatgggcaaggtcagaaaagacattccccagtgggaaccttccaaggggtggaacgattggcagcaagtgcccttctgcagccatcactttcaccagctcatcatgaaagacggccgcgagattgttgtgccttgtcggaatcaggatgagctggtcggaagagctcgcgtgtctcagggcgccgggtggtccctgcgggaaacagcttgcctcggaaagagctacgcccaaatgtggcagctgatgtatttccatagacgcgaccttcggctggcggccaacgctatctgttccgccgtccccgtggattggattccgacctctagaacaacctggagcatccacgcccatcaccagtggatgacgaccgaggacatgctctccgtttggaatcgggtgtggatcgaagagaacccttggatggaagataagacacatattagctcttggggcgacgtcccctacctggggaaaagagaggaccaatggtgcggatcccttatcggcctgaccgctcgcgccacatgggcgaccaatattcaggtggctatcaaccaggttcggagactcattgggaatgagaactacctggattatatgacaagcatgaagcgctttaaaaatgaatctgaccccgagggcgccctgtggtga

SEQ ID NO: 18534 - RNA, 9879 nt, synthetic construct
  misc_feature 1..9879: note = derived and/or modified CDS sequence (opt5) from DENV-1__GU131921__SS-prME
  source 1..9879: mol_type = other RNA
agcgtgacaatgctgctcatgctgatgcccacagcccttgctttccacctgacgacccggggaggggaacctcatatgatcgtgtccaagcaggaacggggaaaatctctcctgtttaagacaagcgccggcgttaacatgtgcacccttatcgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatggccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccatcctgcgcaaactttgcattgaagcgaagatctccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttatcgtgacggtccacaccggcgaccagcatcaagtggggaatgagagcacagaacacggaaccacagctaccattacgccccaggcccctatgaccgagatccagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaattcagacctccggaacaaccacaatctttgctggccatctcaaatgcagactgaagatggataaacttaccctgaaggggatgagctatgttatgtgtacgggctctttcaaactcgagaaggaagtggccgagacacagcacggaaccgtcctggtgcagattaagtacgagggcaccgacgcgccgtgcaaaatccctttctccacacaagatgaaaagggggttacccagaacggacggctgatcacagctaatcccattgtgacggacaaagagaagcctgtcaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtgtttaccagcgttggcaaactggtccatcagattttcggggctgcctacggagtgctcttttccggcgtgagctggacaatgaagatcgggattggcgtcctgcttacctggctgggactcaattctagatccacgagcctgtctatgacctgtatcgctgtgggcctggttacactttacctcggggtgatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacacgcctcgaaaacatcatgtggaaacagatttccaacgagctgaatcatatccttctggaaaacgacatgaagttcaccgtggttgtgggagatgtcgccggcattctcgcccaggggaaaaagatgatccggccgcaacccatggagtacaaatattcttggaaaagctggggaaaggctaagattatcggcgcggacgtgcagaatacgacatttatcattgatgggcctaacacccccgaatgtcctgacgatcagagagcctggaatatctgggaggtggaggactacggattcggcatttttaccacaaacatctggctgaagctgcgcgattcctatacccaggtctgcgaccaccggcttatgagcgctgccattaaagattctaaggccgttcacgctgacatgggctactggatcgaatccgagaaaaatgaaacgtggaagctcgccagagcgagcttcatcgaggtgaagacatgtatttggcccaaatctcataccctgtggtccaacggggtgctggaaagcgagatgatcattccgaagatctatggaggccctatttctcaacacaattaccgccccgggtacttcacacagaccgctggaccttggcatctcggcaaactggagcttgattttgacctgtgcgaagggacaaccgtcgtggttgatgagcactgcggaaaccggggccccagcctcagaacgaccacagtgaccggcaagatcatccacgaatggtgttgccggtcctgtacactgcctcccctgcgcttcagaggggaggacggatgctggtatggcatggagattcggccggtcaaagaaaaggaggaaaatcttgtcaagagcatggtttctgccgggtccggagaggtggacagcttttccctcggcctgctgtgtatctctattatgatcgaagaggtcatgagaagccgctggtcccggaaaatgctcatgaccgggacgctggccgtgttccttctgctcattatgggacagctgacatggaacgatctgatcagactttgcattatggttggcgctaatgcctctgaccgcatgggcatggggaccacatacctggcgctcatggctacctttaagatgagacctatgttcgccgtgggactgctctttcggcgcctgaccagcagagaggtccttctgctcacaatcggcctgtccctggtggcctctgtggaacttcccaacagcctggaggaactcggggatggactggctatgggcatcatgattctcaaactgcttacggacttccaatcccatcagctgtgggccaccctcctgagcctgacatttatcaagaccacattctctcttcactatgcttggaaaaccatggccatggtcctgtccattgttagcctctttcccctgtgtctctctacgacatcccagaagaccacctggctgcctgtgcttctggggagcctgggatgcaagccgctcacaatgttcctgatcgcggagaataaaatttggggccggcgctcttggccccttaacgaaggcatcatggccgtggggatcgtctccattctgctcagctccctgctcaagaacgatgtgcctctggctggaccccttatcgccggcgggatgctgattgcttgttacgttatcagcggatctagcgccgacctgtccctcgagaaagccgctgaggtgtcttgggaagaggaagcggagcatagcggcgcctcccacaatattctggtcgaagtgcaggatgacgggaccatgaagatcaaagatgaggagagagacgatacacttacgatcctgctcaaggctaccctgctcgccgtttctggagtgtatcctctgagcattcccgccacactttttgtctggtacttctggcagaagaagaagcagcggtccggcgtgctgtgggacaccccttctcccccggaagtcgagaaagctgtgctggatgacggcatctatcgcattatgcagagagggctcctgggacggagccaggttggcgtgggggtcttccaagaaaacgtgtttcatacaatgtggcacgttacccgcggagccgtgcttatgtaccagggcaagagactggagccttcctgggcgagcgtcaaaaaggacctcatctcttacgggggaggctggcggctgcagggctcctggaatacgggggaggaagtgcaagtgattgctgttgagcccggcaaaaaccctaagaatgtccaaaccgcccccggcacattcaagaccccggaaggggaggtgggagccatcgctctcgattttaaacctggcacaagcgggtctcccattgtgaacagagaaggaaagatcgtcggcctgtatggcaatggggtggttaccacatccggaacgtacgtgagcgccatcgcgcaggctaaagcctcccaggagggccctcttcccgagattgaagacgaggtcttccgcaagcggaacctgaccatcatggatctgcaccccgggtctggaaaaacaagacgctatctccctgccattgtgcgggaagctatcaagagaaagctgcgcacccttattctggccccgacccgggttgtggctagcgagatggccgaagcgctcaaaggcatgcccatcagataccaaacaacggccgtcaagtccgagcataccgggaaagagatcgtggacctgatgtgccacgctacatttaccatgcgcctgctcagccctgttcgggtgcccaattataacatgattatcatggatgaagcccatttcacagacccttcttccattgctgccagaggctacatcagcacccgggtcggaatgggcgaggccgctgcgatttttatgacggccacaccccctgggtctgtggaggctttcccgcagagcaatgccgtgatccaggatgaggaacgcgacatccccgagagatcctggaactctggatatgagtggattaccgattttcctggcaagaccgtctggttcgttcccagcatcaaatccgggaatgacattgccaactgtcttcggaagaatggaaagcgcgtgatccagctgtctagaaaaacatttgataccgaataccaaaagaccaaaaacaacgactgggactacgtggtcaccacggatattagcgagatgggcgctaatttccgggccgacagagtgatcgatcctcgccggtgcctgaagcccgttattctcaaagacgggccggaaagagtgatcctggcgggccctatgcccgtcacagtggcttccgccgcccagcgccggggaagaatcggccgcaaccacaataaggagggggatcagtatatttacatgggacagccccttaacaatgacgaggatcatgctcactggaccgaagccaagatgctgctcgacaacatcaatacacctgagggcattatccccgcgctgttcgaacctgagcgggagaaaagcgccgctattgatggggagtatagactgcgcggagaggccagaaagacctttgttgaactcatgcggcgcggcgaccttccggtgtggctgtcttacaaagtcgcttccgaggggttccaatatagcgatagacggtggtgctttgacggcgaacgcaacaatcaggtgctggaggaaaacatggatgtcgagatctggacgaaggagggagaacgcaaaaagctccggcccagatggctggacgcccgcacctactccgaccctcttgctctgcgggagttcaaagaatttgccgcgggcagacgctctgtgagcggggatctcatcctggagattggaaagctgccccagcacctcacacagcgggcccaaaatgctcttgacaacctggttatgctgcataattccgaacagggcgggagagcctatcggcacgctatggaggagctccctgataccatcgaaacactgatgcttctggccctcattgccgtgctgaccggaggcgtgacactgttctttctctctggccgcgggcttggaaagaccagcatcggcctgctgtgtgtcatggcttccagcgttctcctgtggatggcgtctgtggagccccattggattgccgcttccatcatccttgagttctttctgatggtgctcctgattccggagcctgacagacagcggacgccccaggataaccaactggcctacgtcgtgatcgggctccttttcatgattctgacagttgccgctaatgagatgggactgctcgaaaccaccaaaaaggacctgggcatcgggcacgtggccgtcggaaaccaccatcacgcggccatgcttgatgtggacctgcatcctgctagcgcctggacactctacgctgtcgccaccacaattatcacgcccatgatgcgccacaccattgagaacacaaccgcgaatatctctctgacagccatcgctaaccaggccgctattctgatgggcctcgataaaggctggcctatctccaagatggacattggggtgccccttctggccctgggatgctatagccaggttaatccgctcaccctgacggctgccgtgcttatgctggtcgcgcattacgccatcattggccctgggctccaagctaaagccaccagagaagctcagaagcggacagccgccggaatcatgaagaaccccaccgtggatggcatcgttgcgattgacctggatcccgtggtctatgacgctaaatttgagaagcagctggggcagatcatgctccttattctgtgtacatctcaaatcctgctcatgcgcaccacgtgggccctgtgcgaaagcattacacttgctaccggacctctgacaaccctctgggagggctccccgggcaaattctggaataccacaatcgccgtgtctatggccaacatctttagagggagctacctggctggagccggcctggcgttctccctcatgaaaagccttgggggaggccggcgcgggacgggagcccagggcgagaccctgggcgaaaaatggaagagacagctgaatcagctctccaagtctgagttcaacacatataaacggagcgggattatggaagtggacagatccgaggctaaggaaggactgaaacgcggcgagaccacaaagcacgccgtttctcgggggaccgctaaacttagatggtttgtcgagcgcaatctggtgaagcccgaaggaaaggtgatcgatctcggctgtgggcggggaggctggagctactattgcgccggcctgaaaaaggtcacggaggttaaagggtacacaaagggaggccctgggcacgaagaacccattcctatggcgacctacggatggaacctggtgaaactccattccggcaaggacgtgttctttattccccctgaaaaatgtgatacccttctgtgcgacattggggagtctagcccgaatcccacaatcgaggaaggaagaaccctgcgcgtcctcaagatggtggagccttggctgcggggcaaccaattctgtattaagatccttaatccctatatgccttccgttgtggaaacactggagcagatgcagagaaaacacggcgggatgctcgtccgcaaccccctgagcagaaattctacgcatgagatgtactgggtgtcctgcggaaccggcaacatcgttagcgccgtgaatatgacatctagaatgctgctcaaccgctttaccatggctcaccggaagccgacatatgaaagagatgtcgacctgggggccggaacccgccacgtggctgtggagcctgaagtcgccaaccttgatattatcggccagagaattgagaatatcaaacatgaacacaagtccacgtggcattacgacgaggataacccctataaaacctgggcttaccacgggagctatgaggttaagccctctggatccgccagctccatggtgaatggcgtggtcaagctgctcacaaaaccttgggacgtgattcccatggttacccaaatcgcgatgacagataccacacctttcggccagcagcgggtgtttaaggaaaaagtcgacacccgcacgccgaaggccaaaagagggacagctcaaatcatggaggtgaccgccaagtggctgtggggattccttagccggaacaagaaacccagaatttgtacccgggaagagtttacacgcaaggttagatctaatgctgccatcggcgccgtgttcgtcgacgaaaaccagtggaatagcgcgaaagaggctgtggaggatgaacggttttgggacctggttcatcgcgagagagaactccacaagcaggggaaatgcgccacgtgcgtgtacaacatgatgggaaagcgggagaagaaactgggcgagttcgggaaggccaaaggctcccgcgctatttggtacatgtggctgggagccagatttctcgagttcgaggctctgggcttcatgaatgaagatcactggttttctcgggagaacagcctttccggggtcgaaggagagggcctgcataagctcgggtatatcctgcgcgacatttctaaaatccctggaggcaatatgtacgccgatgacaccgcggggtgggatacaagaatcaccgaggacgatcttcagaacgaagcccggattacagacatcatggagcccgaacacgctctgctcgccaagagcattttcaaactgacctatcaaaataaggtggtccgcgtgcagagacctgctaagaacggcacagttatggatgtgatctcccggcgcgaccagagaggatctggccaggtcgggacctacggactgaatacgtttaccaacatggaggcccaactcattcggcagatggaaagcgagggcatcttctcccccagcgagctggaaacaccgaaccttgcggagagagtgctggattggctcgaaaaatatggggtggagcgcctgaagcggatggccatctctggagacgactgtgttgtgaaacctattgatgacagatttgctaccgcccttacagctctgaatgatatgggcaaggtccgcaaagacatcccccagtgggaaccttccaaggggtggaacgattggcagcaagtgcccttctgcagccatcactttcaccagctcattatgaaggacggccgggagatcgttgtgccttgtagaaatcaggatgagctggtcggacgcgcccgggtgtctcagggcgctgggtggtccctgagagaaaccgcctgcctcggaaaaagctacgcgcaaatgtggcagctgatgtatttccatcgccgggaccttagactggccgctaacgccatttgttccgccgtccccgtggattggatcccgacgtctcgcacaacctggagcattcacgctcatcaccagtggatgacaaccgaggacatgctctccgtttggaatcgggtgtggatcgaagagaacccttggatggaagataagacgcatatcagctcttggggcgacgtcccctacctggggaaaagagaggaccaatggtgcggatcccttattggcctgaccgcccgggcgacatgggctaccaatatccaggtggccattaaccaggttagacgcctcatcgggaatgagaactacctggattatatgacaagcatgaagcggtttaaaaatgaatctgaccccgagggcgccctgtggtga

SEQ ID NO: 18535 - RNA, 9879 nt, synthetic construct
  misc_feature 1..9879: note = derived and/or modified CDS sequence (opt5) from DENV-1__GQ868635__SS-prME
  source 1..9879: mol_type = other RNA
agcgtgaccatgctgctcatgctgatgcccaccgcccttgctttccacctgacgacccggggaggggaacctcatatgatcgtgtccaagcaggaacggggaaaatctctcctgtttaagacaagcgccggcgttaacatgtgcacccttatcgccatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatggccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccatcctgcgcaaactttgcattgaagcgaagatctccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttatcgtgacggtccacaccggcgaccagcatcaagtggggaatgagagcacagaacacggaaccacagctaccattacgccccaggcccctaccacagagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcggggctgcctacggagtgctcttttccggcgtgagctggaccatgaagatcgggattggcgtcctgcttacgtggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacagaacaatataagtttcaggcggactcccctaaacggctgtctgccgctattggcaaggcctgggaggagggggtctgcggcatcagaagcgctacccgcctcgaaaacatcatgtggaaacagatttccaacgagctgaatcatatccttctggaaaacgacatgaagttcacggtggttgtgggagatgtcgccggcattctcgcccaggggaaaaagatgatccggccgcaacccatggagtacaaatattcttggaaaagctggggaaaggctaagattatcggcgcggacgtgcagaatacaacctttatcattgatgggcctaacacccccgaatgtcctgacgatcagagagcctggaatatctgggaggtggaggactacggattcggcatttttacaaccaacatctggctgaagctgcgcgattcctatacgcaggtctgcgaccaccggcttatgagcgctgccattaaagattctaaggccgttcacgctgacatgggctactggatcgaatccgagaaaaatgaaacatggaagctcgccagagcgagcttcatcgaggtgaagacctgtatttggcccaaatctcatacactgtggtccaacggggtgctggaaagcgagatgatcattccgaagatctatggaggccctatttctcaacacaattaccgccccgggtacttcacccagacagctggaccttggcatctcggcaaactggagcttgattttgacctgtgcgaagggaccacggtcgtggttgatgagcactgcggaaaccggggccccagcctcagaaccacaaccgtgacaggcaagatcatccacgaatggtgttgccggtcctgtaccctgcctcccctgcgcttcagaggggaggacggatgctggtatggcatggagattcggccggtcaaagaaaaggaggaaaatcttgtcaagagcatggtttctgccgggtccggagaggtggacagcttttccctcggcctgctgtgtatctctattatgatcgaagaggtcatgagaagccgctggtcccggaaaatgctcatgacggggacactggccgtgttccttctgctcattatgggacagctgacctggaacgatctgatcagactttgcattatggttggcgctaatgcctctgaccgcatgggcatggggacaacctacctggcgctcatggctacctttaagatgagacctatgttcgccgtgggactgctctttcggcgcctgacaagcagagaggtccttctgctcacgatcggcctgtccctggtggcctctgtggaacttcccaacagcctggaggaactcggggatggactggctatgggcatcatgattctcaaactgcttaccgacttccaatcccatcagctgtgggccacactcctgagcctgacctttatcaagacaaccttctctcttcactatgcttggaaaacgatggccatggtcctgtccattgttagcctctttcccctgtgtctctctacaacctcccagaagaccacatggctgcctgtgcttctggggagcctgggatgcaagccgctcaccatgttcctgatcgcggagaataaaatttggggccggcgctcttggccccttaacgaaggcatcatggccgtggggatcgtctccattctgctcagctccctgctcaagaacgatgtgcctctggctggaccccttatcgccggcgggatgctgattgcttgttacgttatcagcggatctagcgccgacctgtccctcgagaaagccgctgaggtgtcttgggaagaggaagcggagcatagcggcgcctcccacaatattctggtcgaagtgcaggatgacgggacaatgaagatcaaagatgaggagagagacgatacgcttaccatcctgctcaaggctacactgctcgccgtttctggagtgtatcctctgagcattcccgccaccctttttgtctggtacttctggcagaagaagaagcagcggtccggcgtgctgtgggacacaccttctcccccggaagtcgagaaagctgtgctggatgacggcatctatcgcattatgcagagagggctcctgggacggagccaggttggcgtgggggtcttccaagaaaacgtgtttcataccatgtggcacgttacgcgcggagccgtgcttatgtaccagggcaagagactggagccttcctgggcgagcgtcaaaaaggacctcatctcttacgggggaggctggcggctgcagggctcctggaataccggggaggaagtgcaagtgattgctgttgagcccggcaaaaaccctaagaatgtccaaacagcccccggcaccttcaagacaccggaaggggaggtgggagccatcgctctcgattttaaacctggcaccagcgggtctcccattgtgaacagagaaggaaagatcgtcggcctgtatggcaatggggtggttacaacgtccggaacctacgtgagcgccatcgcgcaggctaaagcctcccaggagggccctcttcccgagattgaagacgaggtcttccgcaagcggaacctgacaatcatggatctgcaccccgggtctggaaaaaccagacgctatctccctgccattgtgcgggaagctatcaagagaaagctgcgcacccttattctggccccgacacgggttgtggctagcgagatggccgaagcgctcaaaggcatgcccatcagataccaaacgaccgccgtcaagtccgagcatacagggaaagagatcgtggacctgatgtgccacgctacctttacaatgcgcctgctcagccctgttcgggtgcccaattataacatgattatcatggatgaagcccatttcaccgacccttcttccattgctgccagaggctacatcagcacgcgggtcggaatgggcgaggccgctgcgatttttatgacagccacaccccctgggtctgtggaggctttcccgcagagcaatgccgtgatccaggatgaggaacgcgacatccccgagagatcctggaactctggatatgagtggattaccgattttcctggcaagacagtctggttcgttcccagcatcaaatccgggaatgacattgccaactgtcttcggaagaatggaaagcgcgtgatccagctgtctagaaaaacctttgatacagaataccaaaagaccaaaaacaacgactgggactacgtggtcacgacagatattagcgagatgggcgctaatttccgggccgacagagtgatcgatcctcgccggtgcctgaagcccgttattctcaaagacgggccggaaagagtgatcctggcgggccctatgcccgtcaccgtggcttccgccgcccagcgccggggaagaatcggccgcaaccacaataaggagggggatcagtatatttacatgggacagccccttaacaatgacgaggatcatgctcactggacagaagccaagatgctgctcgacaacatcaatacccctgagggcattatccccgcgctgttcgaacctgagcgggagaaaagcgccgctattgatggggagtatagactgcgcggagaggccagaaagacgtttgttgaactcatgcggcgcggcgaccttccggtgtggctgtcttacaaagtcgcttccgaggggttccaatatagcgatagacggtggtgctttgacggcgaacgcaacaatcaggtgctggaggaaaacatggatgtcgagatctggaccaaggagggagaacgcaaaaagctccggcccagatggctggacgcccgcacatactccgaccctcttgctctgcgggagttcaaagaatttgccgcgggcagacgctctgtgagcggggatctcatcctggagattggaaagctgccccagcacctcacccagcgggcccaaaatgctcttgacaacctggttatgctgcataattccgaacagggcgggagagcctatcggcacgctatggaggagctccctgatacaatcgaaaccctgatgcttctggccctcattgccgtgctgacaggaggcgtgaccctgttctttctctctggccgcgggcttggaaagacgagcatcggcctgctgtgtgtcatggcttccagcgttctcctgtggatggcgtctgtggagccccattggattgccgcttccatcatccttgagttctttctgatggtgctcctgattccggagcctgacagacagcggacaccccaggataaccaactggcctacgtcgtgatcgggctccttttcatgattctgaccgttgccgctaatgagatgggactgctcgaaaccaccaaaaaggacctgggcatcgggcacgtggccgtcggaaaccaccatcacgcggccatgcttgatgtggacctgcatcctgctagcgcctggaccctctacgctgtcgccacaacgattatcacccccatgatgcgccacacaattgagaacaccacagcgaatatctctctgaccgccatcgctaaccaggccgctattctgatgggcctcgataaaggctggcctatctccaagatggacattggggtgccccttctggccctgggatgctatagccaggttaatccgctcacgctgaccgctgccgtgcttatgctggtcgcgcattacgccatcattggccctgggctccaagctaaagccacaagagaagctcagaagcggaccgccgccggaatcatgaagaaccccacagtggatggcatcgttgcgattgacctggatcccgtggtctatgacgctaaatttgagaagcagctggggcagatcatgctccttattctgtgtacctctcaaatcctgctcatgcgcacgacatgggccctgtgcgaaagcattacccttgctacaggacctctgaccaccctctgggagggctccccgggcaaattctggaatacaacgatcgccgtgtctatggccaacatctttagagggagctacctggctggagccggcctggcgttctccctcatgaaaagccttgggggaggccggcgcgggaccggagcccagggcgagacactgggcgaaaaatggaagagacagctgaatcagctctccaagtctgagttcaacacctataaacggagcgggattatggaagtggacagatccgaggctaaggaaggactgaaacgcggcgagacaaccaagcacgccgtttctcgggggacggctaaacttagatggtttgtcgagcgcaatctggtgaagcccgaaggaaaggtgatcgatctcggctgtgggcggggaggctggagctactattgcgccggcctgaaaaaggtcacagaggttaaagggtacaccaagggaggccctgggcacgaagaacccattcctatggcgacctacggatggaacctggtgaaactccattccggcaaggacgtgttctttattccccctgaaaaatgtgatacacttctgtgcgacattggggagtctagcccgaatcccaccatcgaggaaggaagaacactgcgcgtcctcaagatggtggagccttggctgcggggcaaccaattctgtattaagatccttaatccctatatgccttccgttgtggaaacgctggagcagatgcagagaaaacacggcgggatgctcgtccgcaaccccctgagcagaaattctacccatgagatgtactgggtgtcctgcggaacaggcaacatcgttagcgccgtgaatatgacctctagaatgctgctcaaccgctttacaatggctcaccggaagccgacctatgaaagagatgtcgacctgggggccggaacgcgccacgtggctgtggagcctgaagtcgccaaccttgatattatcggccagagaattgagaatatcaaacatgaacacaagtccacctggcattacgacgaggataacccctataaaacatgggcttaccacgggagctatgaggttaagccctctggatccgccagctccatggtgaatggcgtggtcaagctgctcaccaaaccttgggacgtgattcccatggttacacaaatcgcgatgaccgatacaacccctttcggccagcagcgggtgtttaaggaaaaagtcgacacgcgcacaccgaaggccaaaagagggaccgctcaaatcatggaggtgaccgccaagtggctgtggggattccttagccggaacaagaaacccagaatttgtacacgggaagagtttacgcgcaaggttagatctaatgctgccatcggcgccgtgttcgtcgacgaaaaccagtggaatagcgcgaaagaggctgtggaggatgaacggttttgggacctggttcatcgcgagagagaactccacaagcaggggaaatgcgcgacctgcgtgtacaacatgatgggaaagcgggagaagaaactgggcgagttcgggaaggccaaaggctcccgcgctatttggtacatgtggctgggagccagatttctcgagttcgaggctctgggcttcatgaatgaagatcactggttttctcgggagaacagcctttccggggtcgaaggagagggcctgcataagctcgggtatatcctgcgcgacatttctaaaatccctggaggcaatatgtacgccgatgacacagcggggtgggataccagaatcacagaggacgatcttcagaacgaagcccggattaccgacatcatggagcccgaacacgctctgctcgccaagagcattttcaaactgacatatcaaaataaggtggtccgcgtgcagagacctgctaagaacggcaccgttatggatgtgatctcccggcgcgaccagagaggatctggccaggtcgggacgtacggactgaatacctttacaaacatggaggcccaactcattcggcagatggaaagcgagggcatcttctcccccagcgagctggaaaccccgaaccttgcggagagagtgctggattggctcgaaaaatatggggtggagcgcctgaagcggatggccatctctggagacgactgtgttgtgaaacctattgatgacagatttgctacagcccttaccgctctgaatgatatgggcaaggtccgcaaagacatcccccagtgggaaccttccaaggggtggaacgattggcagcaagtgcccttctgcagccatcactttcaccagctcattatgaaggacggccgggagatcgttgtgccttgtagaaatcaggatgagctggtcggacgcgcccgggtgtctcagggcgctgggtggtccctgagagaaacggcctgcctcggaaaaagctacgcgcaaatgtggcagctgatgtatttccatcgccgggaccttagactggccgctaacgccatttgttccgccgtccccgtggattggatcccgacatctcgcaccacatggagcattcacgctcatcaccagtggatgaccacggaggacatgctctccgtttggaatcgggtgtggatcgaagagaacccttggatggaagataagacccatatcagctcttggggcgacgtcccctacctggggaaaagagaggaccaatggtgcggatcccttattggcctgacagcccgggcgacctgggctacaaatatccaggtggccattaaccaggttagacgcctcatcgggaatgagaactacctggattatatgaccagcatgaagcggtttaaaaatgaatctgaccccgagggcgccctgtggtga

SEQ ID NO: 18536 - RNA, 9879 nt, synthetic construct
  misc_feature 1..9879: note = derived and/or modified CDS sequence (opt5) from DENV-1__GQ868636__SS-prME
  source 1..9879: mol_type = other RNA
tccgtgaccatgctgctcatgctgatgcccaccgcccttgctttccacctgacgaccagaggcggggaacctcatatgatcgtcacaaagcaggaacggggaaagtcccttctgtttaagacctctgccggcgttaatatgtgcacccttattgcgatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggctcggagaggtcgactcctttagcctgggcctgctctgtatctccattatgatcgaagaggtgatgcggtctagatggagccgcaagatgctgatggctgggacacttgccgttttcctgctcctgattatgggacagctgacctggaacgatcttatccggctgtgcattatggtgggcgccaatgcttccgacagaatgggcatggggacaacctatctcgccctgatggcgacctttaaaatgcgccctatgttcgctgtcggactcctgtttagacggcttacatctcgcgaggtgctgctcctgacgatcggcctgagccttgtggcctccgtcgaactgcccaactctctcgaggaactgggggatggactcgccatgggcatcatgattctgaaacttctgaccgacttccaaagccaccagctctgggctacactgctgtcccttacctttatcaaaacaaccctgagcctccatcacgcctggaagacgatggctatggttctgtctattgtgtccctcttccccctgtgtcttagcacaacctctcagaagaccacatggctgcctgtgctgctcgggtccctgggatgcaaaccgcttaccatgtttctgatcgccgagaataagatttggggcagaaaaagctggcccctcaacgaaggcatcatggcggtcggggtggtttctatcctgctctccagcctgcttaagaacgatgtgcctctggccggacccctgattgctggcgggatgctcatcgcctgttacgtcatttccggaagctctgctgacctgagccttgagaaagccgccgaggtgtcctgggaagaggaagctgagcattctggcgcgagccacaatatcctggttgaagtgcaggatgacgggacaatgaagattaaagatgaggagcgggacgatacgctcaccatcctgctcaaggccacactgcttgctatctccggagtctatcctctgtctattcccgccaccctgttcgtgtggtacttttggcaaaagaaaaagcagcgcagcggcgtcctctgggacacacctagccctcccgaagtggagagagccgttctggatgacggcatctatcggattatgcagcgcgggcttctgggaagatctcaggtgggcgtcggggtgttccaagaaaacgttttccacaccatgtggcatgtgacgcggggagctgtcctcatgtaccagggcaaacgcctggagcccagctgggcctccgtgaagaaagacctcatcagctatgggggaggctggagactgcagggctcttggaataccggggaggaagtgcaggttattgcggtcgagcccggaaagaaccctaagaatgtgcaaacagctcccggcacctttaaaacaccggaaggggaggtgggagccatcgcccttgatttcaagcctggcacctccgggagccccattgtcaaccgggaaggaaaaatcgtgggcctgtacggcaatggggttgtgacaacgtctggaacctacgtctccgctatcgcccaggcgaaggctagccaggagggccctctgcccgagattgaagacgaggtgtttagaaaacgcaacctcacaatcatggatctgcaccccgggtccggaaagacccggagatatcttcctgccattgttcgcgaagccatcaagcggaaactgagaaccctcattctggctccgacacgcgtggtcgcctctgagatggctgaagccctgaagggcatgcccatccggtaccaaacgaccgcggtgaaaagcgagcatacagggaaggagatcgttgacctcatgtgccacgccaccttcacaatgagacttctgtcccctgtgcgcgtccccaattataacatgattatcatggatgaagctcattttaccgaccctagctctattgccgctcggggctacatctccacgagagtgggaatgggcgaggccgccgctattttcatgacagcgacaccccctgggagcgtggaagcctttccgcagtctaatgctgtcatccaggatgaggaacgggacatccccgagcgcagctggaactccggatatgagtggattaccgatttccctggcaaaacagtttggtttgtgccctctatcaagagcgggaatgacattgccaactgtctgagaaagaatggaaaacgggtgatccagctctcccgcaagaccttcgatacagaataccagaagaccaagaacaacgactgggactatgtcgtgacgacagatatttctgagatgggcgccaattttagagctgaccgggttatcgatcctagacgctgcctgaaacccgtgattcttaaggacgggccggaacgggtcatcctggccggccctatgcccgtgaccgttgcgagcgctgcccagagacgcggacggatcggcagaaaccacaataaggagggggatcagtacatttacatgggacagcccctcaacaatgacgaggatcacgcccattggacagaagctaaaatgctgctggacaacatcaatacccctgagggcattatccccgccctcttcgaacctgagcgcgaaaagtccgcggccattgatggggagtatcggcttagaggagaggctcgcaaaacgttcgtggaactgatgagacggggcgacctgccggtctggctcagctacaaggtggcctctgaggggtttcaatattccgatcgcagatggtgcttcgacggcgaacggaacaatcaggtcctggaggaaaacatggatgtggagatctggaccaaagagggagaacgcaagaaacttagaccccggtggctggacgctagaacatacagcgaccctctcgccctgcgcgagtttaaggagttcgctgccggccggagatccgtttctggggatctgatcctcgagattggaaaacttccccagcacctgacccagcgcgcgcaaaatgccctggacaacctcgtgatgctgcataatagcgaacagggcgggcgggcttatagacacgccatggaggagcttcctgatacaatcgaaaccctgatgctcctggctctgattgccgtgctcacaggaggcgtcaccctctttttcctgtccggccgggggctgggaaaaacgtctatcggcctcctgtgtgttatggccagctccgtgcttctgtggatggctagcgtggagccccactggattgcggcctctatcatcctcgaatttttcctgatggtcctgctcattccggagcctgaccgccagagaacaccccaggataaccaacttgcttacgtggttatcgggctgctgtttatgattctcaccgtggccgccaatgagatgggactgcttgaaaccacaaagaaagacctgggcatcgggcatgtcgctgtggagaaccaccatcacgccaccatgctcgatgtcgacctgcatcctgcgtccgcctggacactgtatgctgtggccacgaccattatcacacccatgatgcggcacaccattgaaaacacaaccgctaatatcagcctcacggccatcgcgaaccaggccgctattcttatgggactggataagggctggcctatctctaaaatggacattggcgttcccctgctcgccctggggtgctactcccaggtgaatccgcttaccctgacagctgccgtcctcatgctggtggctcactacgccatcattggacctggcctgcaagcgaaggccacccgcgaggctcagaagagaacagccgctgggatcatgaaaaaccccaccgttgatggaatcgtggccattgacctcgatcccgtcgtgtatgacgccaagttcgaaaaacagcttggccagatcatgctgctgattctctgtacgagccaaatcctgcttatgcggacaacctgggcgctgtgcgagtctattacactcgctaccgggcctctgaccacactgtgggagggaagcccgggcaagttttggaatacgaccatcgccgtgtccatggctaacatcttccgcggctcttacctcgccggggccggacttgcttttagcctgatgaaatccctgggcgggggaagacggggcacaggggcccagggagaaaccctcggcgagaagtggaagcgccagctgaatcagcttagcaaatccgagttcaacatttataagagatctggcatcatggaggttgaccggagcgaagcgaaagaggggctgaagagaggagagacaacccgccatgccgtctcccggggcacggctaaactcagatggttcgtggaacgcaatctggtgaagcccgaggggaaggtcattgatctgggatgtggcagagggggatggtcttactattgcgccggcctcaaaaaggttacagaagtgaaaggctacaccaaagggggacctggccacgaggaacccatccctatggctacctatgggtggaaccttgtgaaactgcatagcggaaaggacgtctttttcacaccccctgagagatgtgataccctgctctgcgacattggcgagtcctctccgaatcccacaatcgaagaggggcgcacgctgcgggtgcttaaaatggttgaaccttggctgagaggaaaccaattttgtattaagatcctcaatccctacatgcctagcgtggtcgagaccctggagcagatgcagcgcaagcacggcggcatgctggtgcggaaccccctctccagaaatagcacacacgaaatgtactgggtttcttgcgggaccggaaacatcgtgtccgccgtcaatatgacaagccgcatgctgcttaaccggttcaccatggcgcatagaaaaccgacgtatgagcgcgatgtggacctgggcgccgggaccagacacgtggctgtcgaacctgaggttgccaacctcgatattatcggacagcggattgaaaatatcaagcatgagcacaaatctacatggcattacgacgaggataacccctataagacctgggcttaccacggctcctatgaagtgaaacccagcgggtctgcctccagcatggtgaatggagtcgtgaagctgcttacaaagccttgggacgttattcccatggtgacccaaatcgctatgacagataccacgccttttggccagcagcgcgtcttcaaagagaaggtggacacaagaaccccgaaagccaagcggggcaccgcgcaaatcatggaagttacagccagatggctgtgggggtttctctcccggaacaaaaagccccgcatttgtacgagagaggagttcacccggaaggtgcgcagcaatgctgccatcggagctgtctttgtggacgagaaccagtggaactctgccaaagaggccgttgaagatgagagattctgggacctggtgcagaaggaacgggagctgcacaaacagggcaagtgcgcgacatgcgtctacaacatgatggggaaacgcgaaaagaagctcggagagtttggcaaagctaaggggagcagagccatttggtatatgtggctgggcgcccggttccttgagtttgaagctctgggattcatgaatgaggatcattggttctcccgcgaaaactctctcagcggcgtggagggggagggactgcacaaacttggctacatcctgagagacatttccaagatccctgggggaaatatgtacgccgatgacaccgctggctgggatacacggatcaccgaagacgatctccaaaacgaggccaaaattacagacatcatggaacccgagcatgcgctgctggccacctctatttttaagctcacgtatcagaataaagtcgtgcgcgttcagagacctgctaagaacgggaccgtgatggatgtcatcagccggcgcgaccagagaggctccggacaagtgggcacatacgggctgaataccttcacaaacatggaagcccagcttattcggcagatggagtctgagggaatctttctgcccagcgaactcgagaccccgaacctggctgaaagagtgcttgattggctggagaagcacggcgttgaacgcctcaaacggatggccatctccggggacgactgtgtggtcaagcctattgatgacagattcgcgacggccctgacagctctgaatgatatgggaaaagtgcgcaaggacatcccccagtgggagcctagcaaaggctggaacgattggcaacaggttcccttttgctctcaccatttccaccagctcattatgaaggacgggcgggagatcgtggtcccttgtagaaatcaggatgaactggtgggccgcgcccgggtctcccaaggagctggctggagccttagagagaccgcctgcctggggaagtcttatgctcagatgtggcagctcatgtactttcatcgccgggacctgagacttgccgcgaacgccatttgttccgctgtgcccgttgattgggtgccgacaagccgcaccacgtggtccatccacgcccatcaccaatggatgaccacagaagacatgctgtctgtctggaatcgggtgtggattgaggaaaacccttggatggaggataaaacccacgttagctcctggggagacgtgccctatctcggcaagagagaggaccagtggtgcgggagcctgatcggactgacagcccgggctacctgggcctctaatatccaggtcgcgattaaccaggtgagacgcctcatcggcaatgaaaactacctggattatatgacatccatgaaacggttcaagaatgagggggaccccgaaggcgctctttggtga

SEQ ID NO: 18537 - RNA, 9879 nt, synthetic construct
  misc_feature 1..9879: note = derived and/or modified CDS sequence (opt5) from DENV-1__GU131922__SS-prME
  source 1..9879: mol_type = other RNA
agcgtgatcatgctgctcatgctgatgcccaccgcccttgctttccacctgacaacgagaggcggggagcctcatatgatcgtgtccaagcaggaacggggaaaatctctcctgtttaagaccagcgccggcgttaacatgtgcacccttatcgcgatggacctgggggagctctgtgaagataccatgacatacaaatgcccccgcattaccgaggctgaacccgacgatgtggactgttggtgcaatgccacagatacctgggtgacgtatggaacctgttcccaaacaggcgagcacagacgggacaagcgctctgtggccctggctcctcatgtggggctgggactcgagaccagaacagaaacctggatgagctccgagggcgcctggaaacagatccagcgggttgaaacgtgggctctgcgccaccccggcttcacagtgattgccctttttctggcgcatgccatcgggacctctatcacacagaagggaattatcttcattctcctgatgcttgtcacccctagcatggctatgagatgcgtgggcatcgggtcccgggattttgttgagggactgagcggcgccacctgggtggacgtcgtgctcgagcacgggtcttgtgtgacaacgatggctaaggataaacccaccctggacattgaactgctcaagacagaggtcaccaaccctgccatcctgcgcaaactttgcattgaagcgaagatctccaatacaaccacggatagcagatgtccgacacaaggagaggccaccctggttgaagaacaagacgctaacttcgtgtgccggcgcacctttgtggatagaggctggggcaatgggtgtggactcttcggcaaagggtctctgatcacatgcgccaagtttaagtgcgtcaccaaacttgagggaaagattgtgcagtacgaaaacctgaaatattccgttatcgtgacagtccacacgggcgaccagcatcaagtggggaatgagagcaccgaacacggaacaaccgctacaattacgccccaagcccctaccaccgagatccagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaattcagacctccggaacaaccacaatctttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaattcctttctccacacaagatgaaaagggggttacccagaacggacggctgatcacagctaatcccattgtgacggacaaagagaagcctgtcaacatcgaagccgagccgccctttggcgagagctatattgtgatcggggccggagaaaaagctcttaagctctcttggttcaagaaaggcagctccatcgggaagatgtttgaggccaccgctagaggcgcccgccggatggcgattctgggagatacagcctgggacttcggctctatcgggggagtgtttaccagcgttggcaaactggtccatcagattttcgggacagcttacggagtgctcttttccggcgtgagctggaccatgaagatcgggattggcgtcctgcttacgtggctgggactcaattctagatccaccagcctgtctatgacatgtatcgccgtgggcctggttaccctttacctcggggtgatggtccaggctgattccggatgcgtgattaactggaaaggccgcgaactgaagtgtgggagcggaatcttcgttacaaatgaggtgcacacctggacagaacaatataagtttcaggccgactcccctaaacggctgtctgcggccatcggcaaggcttgggaggagggggtctgcggcattagaagcgccacccgcctcgaaaacatcatgtggaaacagatttccaacgagctgaatcatatccttctggaaaacgacatgaagttcacggtggttgtgggagatgtcgctggcattctcgcccaggggaaaaagatgatccggccgcaacccatggagtacaaatattcttggaaaagctggggaaaggccaagatcattggcgctgacgtgcagaatacaacctttatcattgatgggcctaacacccccgaatgtcctgacgatcagagagcgtggaatatctgggaggtggaggactacggattcggcatttttacaaccaacatctggctgaagctgcgcgattcctatacgcaggtctgcgaccaccggcttatgagcgccgctatcaaagattctaaggccgttcacgccgacatgggctactggattgaatccgagaaaaatgaaacatggaagctcgctagagccagcttcatcgaggtgaagacctgtatttggcccaaatctcatacactgtggtccaacggggtgctggaaagcgagatgatcattccgaagatctatggaggccctatctctcaacacaattaccgccccgggtacttcacccagacagcgggaccttggcatctcggcaaactggagcttgattttgacctgtgcgaagggaccacggtcgtggttgatgagcactgcggaaaccggggccccagcctcagaaccacaaccgtgacaggcaagattatccacgaatggtgttgccggtcctgtaccctgcctcccctgcgcttcagaggggaggacggatgctggtatggcatggagattcggccggtcaaagaaaaggaggaaaatcttgtcaagagcatggtttctgctgggtccggagaggtggacagcttttccctcggcctgctgtgtatctctattatgatcgaagaggtcatgagaagccgctggtcccggaaaatgctcatgacggggacactggccgtgttccttctgctcattatgggacagctgacctggaacgatctgatcagactttgcatcatggttggcgccaatgcttctgaccgcatgggcatggggacaacctacctggccctcatggcgacctttaagatgagacctatgttcgctgtgggactgctctttcggcgcctgacaagcagagaggtccttctgctcacgattggcctgtccctggtggcctctgtggaacttcccaacagcctggaggaactcggggatggactggccatgggcatcatgattctcaaactgcttaccgacttccaatcccatcagctgtgggctacactcctgagcctgacctttatcaagacaaccttctctcttcactatgcctggaaaacgatggctatggtcctgtccattgttagcctctttcccctgtgtctctctacaacctcccagaagaccacatggctgcctgtgcttctggggagcctgggatgcaagccgctcaccatgttcctgatcgccgagaataaaatctggggccggcgctcttggccccttaacgaaggcattatggcggtggggatcgtctccattctgctcagctccctgctcaagaacgatgtgcctctggccggaccccttatcgctggcgggatgctgattgcctgttacgttatcagcggatctagcgctgacctgtccctcgagaaagccgccgaggtgtcttgggaagaggaagctgagcatagcggcgcgtcccacaatatcctggtcgaagtgcaggatgacgggacaatgaagattaaagatgaggagagagacgatacgcttaccatcctgctcaaggccacactgctcgctgtttctggagtgtatcctctgagcattcccgccaccctttttgtctggtacttctggcagaagaagaagcagcggtccggcgtgctgtgggacacaccttctcccccggaagtcgagcgcgccgtgctggatgacggcatctatagaattatgcagcgggggctcctgggacgcagccaggttggcgtgggggtcttccaagaaaacgtgtttcataccatgtggcacgttacgagaggagctgtgcttatgtaccagggcaaacggctggagccttcctgggccagcgtcaagaaagacctcatctcttacgggggaggctggagactgcagggctcctggaataccggggaggaagtccaggtgattgcggttgagcccggaaagaaccctaaaaatgtccaaacagctcccggcaccttcaagacaccggaaggggaggtgggagccatcgccctcgattttaagcctggcaccagcgggtctcccatcgtgaaccgcgaaggaaaaattgtcggcctgtatggcaatggggtggttacaacgtccggaacctacgtgagcgctatcgcccaggcgaaggcttcccaggagggccctcttcccgagattgaagacgaggtcttccggaaaagaaacctgacaatcatggatctgcaccccgggtctggaaagacccgccggtatctccctgccattgtgagagaagccatcaaacgcaagctgcggacccttatcctggctccgacaagagttgtggccagcgagatggctgaagccctcaagggcatgcccattcgctaccaaacgaccgcggtcaaatccgagcatacagggaaggagatcgtggacctgatgtgccacgccacctttacaatgcggctgctcagccctgttagagtgcccaattataacatgattatcatggatgaagctcatttcaccgacccttcttccattgccgctcggggctacatcagcacgcgcgtcggaatgggcgaggccgccgctatctttatgacagcgacaccccctgggtctgtggaagccttcccgcagagcaatgctgtgattcaggatgaggaaagagacatccccgagcggtcctggaactctggatatgagtggattaccgattttcctggcaaaacagtctggttcgttcccagcatcaagtccgggaatgacattgccaactgtcttcgcaaaaatggaaagagagtgatccagctgtctcggaagacctttgatacagaataccagaaaaccaagaacaacgactgggactacgtggtcacgacagatattagcgagatgggcgccaatttcagagctgaccgcgtgatcgatcctcggagatgcctgaaacccgttatcctcaaggacgggccggaacgcgtgattctggccggccctatgcccgtcaccgtggcgtccgctgcccagcggagaggacgcatcggccggaaccacaataaagagggggatcagtatatttacatgggacagccccttaacaatgacgaggatcatgcccactggacagaagctaagatgctgctcgacaacatcaatacccctgagggcattatccccgccctgttcgaacctgagagagaaaagagcgcggccatcgatggggagtatcgcctgagaggagaggctcggaaaacgtttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatttggaccaaagagggagaacggaagaaactcagaccccgctggctggacgctcggacatactccgaccctcttgccctgagagagttcaaggaatttgctgccggccgccggtctgtgagcggggatctcatcctggagattggaaaactgccccagcacctcacccagagagcgcaaaatgcccttgacaacctggttatgctgcataattccgaacagggcgggcgggcttatcgccacgccatggaggagctccctgatacaatcgaaaccctgatgcttctggctctcattgccgtgctgacaggaggcgtgaccctgttctttctctctggcagagggcttggaaagacgagcatcggcctgctgtgtgtcatggcctccagcgttctcctgtggatggcttctgtggagccccattggatcgcggcctccattatccttgagttctttctgatggtgctcctgattccggagcctgaccggcagcgcacaccccaggataaccaactggcttacgtcgtgatcgggctccttttcatgattctgaccgttgccgccaatgagatgggactgctcgaaaccacaaagaaagacctgggcatcgggcacgtggctgtcggaaaccaccatcacgccgcgatgcttgatgtggacctgcatcctgccagcgcttggaccctctacgccgtcgctacaacgattatcacccccatgatgagacacacaatcgagaacaccacagccaatatttctctgaccgcgatcgccaaccaggctgccattctgatgggcctcgataagggctggcctatctccaaaatggacattggggtgccccttctggctctgggatgctatagccaggttaatccgctcacgctgaccgccgctgtgcttatgctggtcgcccattacgcgatcatcggccctgggctccaagccaaggctacacgggaagcccagaaacgcaccgctgccggaattatgaagaaccccacagtggatggcatcgttgccattgacctggatcccgtggtctatgacgcgaagtttgagaaacagctggggcagatcatgctccttattctgtgtacctctcaaatcctgctcatgagaacgacatgggctctgtgcgaaagcatcacccttgccacaggacctctgaccaccctctgggagggctccccgggcaagttctggaatacaacgattgctgtgtctatggccaacatctttcgggggagctacctggccggagctggcctggccttctccctcatgaaaagccttgggggaggccgcagagggaccggagcgcagggcgagacactgggcgaaaagtggaaacggcagctgaatcagctctccaagtctgagttcaacacctataagagaagcgggattatggaagtggaccgctccgaggccaaagaaggactgaagcggggcgagacaaccaaacacgctgtttctagagggacggccaaacttcgctggtttgtcgagcggaatctggtgaaacccgaaggaaaggtgatcgatctcggctgtgggagaggaggctggagctactattgcgctggcctgaagaaagtcacagaggttaaggggtacaccaaaggaggccctgggcacgaagaacccattcctatggccacctacggatggaacctggtgaagctccattccggcaaagacgtgttctttattccccctgaaaagtgtgatacacttctgtgcgacattggggagtctagcccgaatcccaccatcgaggaaggacgcacactgcgggtcctcaaaatggtggagccttggctgagaggcaaccaattctgtatcaagattcttaatccctatatgccttccgttgtggaaacgctggagcagatgcagcgcaagcacggcgggatgctcgtccggaaccccctgagcagaaattctacccatgagatgtactgggtgtcctgcggaacaggcaacatcgttagcgcggtgaatatgacctctcgcatgctgctcaaccggtttacaatggcccacagaaaaccgacctatgaacgcgatgtcgacctgggggctggaacgagacacgtggccgtggagcctgaagtcgctaaccttgatattatcggccagcggattgagaatatcaagcatgaacacaaatccacctggcattacgacgaggataacccctataagacatgggcctaccacgggagctatgaggttaaaccctctggatccgctagctccatggtgaatggcgtggtcaagctgctcaccaagccttgggacgtgatccccatggttacacaaattgccatgaccgatacaacccctttcggccagcagcgcgtgtttaaagaaaaggtcgacacgagaacaccgaaagcgaagcgggggaccgcccaaatcatggaggtgaccgctaaatggctgtggggattccttagcagaaacaagaagccccggatttgtacacgcgaagagtttacgagaaaagttcggtctaatgccgctatcggcgccgtgttcgtcgacgaaaaccagtggaatagcgccaaggaggcggtggaggatgaacgcttttgggacctggttcataaagagagagaactccacaagcaggggaaatgcgctacctgcgtgtacaacatgatgggaaagcgggagaagaaactgggcgagttcgggaaggccaaaggctcccgcgccatttggtacatgtggctgggagctagatttctcgagttcgaggccctgggcttcatgaatgaagatcactggttttctcgggagaacagcctttccggggtcgaaggagagggcctgcataagctcgggtatatcctgcgcgacatctctaaaattcctggaggcaatatgtacgctgatgacacagccgggtgggataccagaatcacagaggacgatcttcagaacgaagcgcggattaccgacatcatggagcccgaacacgccctgctcgctaagagcattttcaaactgacatatcaaaataaggtggtccgcgtgcagagacctgccaagaacggcaccgttatggatgtgatctcccggcgcgaccagagaggatctggccaggtcgggacgtacggactgaatacctttacaaacatggaggctcaactcatccggcagatggaaagcgagggcattttctcccccagcgagctggaaaccccgaaccttgccgagagagtgctggattggctcgaaaaatatggggtggagcgcctgaagcggatggcgatctctggagacgactgtgttgtgaaacctattgatgacagatttgccacagctcttaccgccctgaatgatatgggcaaggtccgcaaagacatcccccagtgggaaccttccaaggggtggaacgattggcagcaagtgcccttctgcagccatcactttcaccagctcattatgaaggacggccgggagatcgttgtgccttgtagaaatcaggatgagctggtcggacgcgctcgggtgtctcagggcgccgggtggtccctgagagaaacggcttgcctcggaaaaagctacgcccaaatgtggcagctgatgtatttccatcgccgggaccttagactggcggccaacgctatttgttccgccgtccccgtggattggatcccgacatctcgcaccacatggagcatccacgcccatcaccagtggatgaccacggaggacatgctctccgtttggaatcgggtgtggattgaagagaacccttggatggaagataagacccatatcagctcttggggcgacgtcccctacctggggaaaagagaggaccaatggtgcggatcccttattggcctgacagctcgggccacctgggcgacaaatatccaggtggctattaaccaggttagacgcctcatcgggaatgagaactacctggattatatgaccagcatgaagcggtttaaaaatgaatctgaccccgagggcgccctgtggtga

SEQ ID NO: 18538 - RNA, 9879 nt, synthetic construct
  misc_feature 1..9879: note = derived and/or modified CDS sequence (opt5) from DENV-1__GU131923__SS-prME
  source 1..9879: mol_type = other RNA
agcgtgaccatgctgctcatgctgatgcccaccgcccttgctttccacctgacgacccggggaggggaacctcatatgatcgtgtccaagcaggaacggggaaaatctctcctgtttaagaccagcgccggcgttaacatgtgcacccttatcgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaggacgctaacttcgtgtgccggcgcacagtggtcgatagaggctggggcaatgggtgtggactctttggcaaagggtctctgattacctgcgccaagttcaagtgcgtgacaaaacttgagggaaagatcgttcagtacgaaaacctgaaatattccgtgattgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgactttaacgaaatggtgctgcttacgatgaaggagaaatcctggctggtccataagcagtggttcctcgatctgcctcttccctggacaagcggggcttccacctctcaagagacatggaatcgccaggacctgctcgtgacctttaaaaccgcgcacgccaagaagcaggaagtcgtggttctgggaagccaagagggcgctatgcacacagccctgacgggggccaccgaaatccagacatccggaaccacaaccattttcgctggccatctcaaatgcagactgaagatggataaacttacgctgaaggggatgagctatgtgatgtgtacaggctcttttaaactcgagaaggaagtcgccgagacccagcacggaaccgtgctggttcagatcaagtacgagggcacagacgcgccgtgcaaaatccctttctccacccaagatgaaaaggggattacacagaacggacggctgatcacggctaatcccattgtgaccgacaaagagaagcctgtcaacatcgaagccgagccgcccttcggcgagagctatattgtgatcggggccggagaaaaagctcttaagctctcttggtttaagaaaggcagctccatcgggaagatgttcgaggccacagctagaggcgcccgccggatggcgattctgggagataccgcctgggactttggctctatcgggggagtgttcacaagcgttggcaaactggtccatcagatttttgggaccgcttacggagtcctgttctccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatctttgttaccaatgaggtgcacacatggaccgaacaatataagttccaggccgactcccctaaacggctgtctgcggccatcggcaaggcttgggaggagggggtctgcggcattagaagcgccacgcgcctcgaaaacatcatgtggaaacagatttccaacgagctgaatcatatccttctggaaaacgacatgaagtttacagtggttgtgggagatgtcgctggcattctcgcccaggggaaaaagatgatccggccgcaacccatggagtacaaatattcttggaaaagctggggaaaggccaagatcattggcgctgacgtgcagaataccaccttcatcattgatgggcctaacacacccgaatgtcctgacgatcagagagcgtggaatatctgggaggtggaggactacggatttggcattttcaccacgaacatctggctgaagctgcgcgattcctatacacaggtctgcgaccaccggcttatgagcgccgctatcaaagattctaaggccgttcacgccgacatgggctactggattgaatccgagaaaaatgaaacctggaagctcgctagagccagctttatcgaggtgaagacatgtatttggcccaaatctcataccctgtggtccaacggggtgctggaaagcgagatgatcattccgaagatctatggaggccctatctctcaacacaattaccgccccgggtacttcacacagaccgcgggaccttggcatctcggcaaactggagcttgatttcgacctgtgcgaagggacgaccgtcgtggttgatgagcactgcggaaaccggggccccagcctcagaacaaccacagtgaccggcaagattatccacgaatggtgttgccggtcctgtacgctgcctcccctgcgctttagaggggaggacggatgctggtatggcatggagattcggccggtcaaagaaaaggaggaaaatcttgtgaaaagcatggtttctgctgggtccggagaggtggacagcttctccctcggcctgctgtgtatctctattatgatcgaagaggtcatgagaagccgctggtcccggaaaatgctcatgacagggaccctggccgtgtttcttctgctcattatgggacagctgacatggaacgatctgatcagactttgcatcatggttggcgccaatgcttctgaccgcatgggcatggggaccacctacctggccctcatggcgacattcaagatgagacctatgtttgctgtgggactcctcttccggcgcctgacgagcagagaggtccttctgctcaccattggcctgtccctggtggcctctgtggaacttcccaacagcctggaggaactcggggatggactggccatgggcatcatgattctcaaactgcttacagactttcaatcccatcagctgtgggctaccctcctgagcctgacattcatcaagaccacgttttctcttcactatgcctggaaaacaatggctatggtcctgtccattgttagcctcttccccctgtgtctctctaccacctcccagaagacaacctggctgcctgtgcttctggggagcctgggatgcaagccgctcacaatgtttctgatcgccgagaataaaatctggggcaagcggtcttggccccttaacgaaggcattatggcggtggggatcgtctccattctgctcagctccctgctcaaaaacgatgtgcctctggccggaccccttatcgctggcgggatgctgattgcctgttacgttatcagcggatctagcgctgacctgtccctcgagaaggccgccgaggtgtcttgggaagaggaagctgagcatagcggcgcgtcccacaatatcctggtcgaagtgcaggatgacgggacgatgaaaattaaggatgaggagcgcgacgatacccttacaatcctgctcaaagccaccctgctcgctgtttctggagtgtatcctctgagcattcccgccacacttttcgtctggtacttttggcaaaagaagaaacagagatccggcgtgctgtgggacaccccttctcccccggaagtcgagcgggccgtgctggatgacggcatctatcgcattatgcagagagggctcctgggacggagccaggttggcgtgggggtcttccaagaaaacgtgttccatacgatgtggcacgttacccgcggagctgtgcttatgtaccagggcaagagactggagccttcctgggccagcgtcaaaaaggacctcatctcttacgggggaggctggcggctgcagggctcctggaatacaggggaggaagtccaggtgattgcggttgagcccggcaagaaccctaagaatgtccaaaccgctcccggcacatttaagaccccggaaggggaggtgggagccatcgccctcgatttcaaacctggcacaagcgggtctcccatcgtgaacagagaaggaaagattgtcggcctgtatggcaatggggtggttacgacctccggaacatacgtgagcgctatcgcccaggcgaaggcttcccaggagggccctcttcccgagattgaagacgaggtctttcgcaagcggaacctgaccatcatggatctgcaccccgggtctggaaaaaccagacgctatctccctgccattgtgcgggaagccatcaagagaaagctgcgcacacttatcctggctccgacgcgggttgtggccagcgagatggctgaagccctcaaaggcatgcccattagataccaaaccacagcggtcaagtccgagcataccgggaaagagatcgtggacctgatgtgccacgccacattcaccatgcgcctgctcagccctgttcgggtgcccaattataacatgattatcatggatgaagctcattttacggacccttcttccattgccgctagaggctacatcagcacacgggtcggaatgggcgaggccgccgctatcttcatgaccgcgacaccccctgggtctgtggaagcctttccgcagagcaatgctgtgattcaggatgaggaacgcgacatccccgagagatcctggaactctggatatgagtggattacagatttccctggcaagaccgtctggtttgttcccagcatcaaatccgggaatgacattgccaactgtcttcggaagaatggaaagcgcgtgatccagctgtctagaaaaacattcgataccgaataccaaaagacgaaaaacaacgactgggactacgtggtcacaaccgatattagcgagatgggcgccaattttcgggctgacagagtgatcgatcctcgccggtgcctgaagcccgttatcctcaaagacgggccggaaagagtgattctggccggccctatgcccgtcacagtggcgtccgctgcccagcgccggggaagaatcggccgcaaccacaataaggagggggatcagtatatttacatgggacagccccttaacaatgacgaggatcatgcccactggaccgaagctaagatgctgctcgacaacatcaatacgcctgagggcattatccccgccctgttcgaacctgagcgggagaaaagcgcggccatcgatggggagtatagactgcgcggagaggctagaaagaccttcgttgaactcatgcggcgcggcgaccttccggtgtggctgtcttacaaagtcgcctccgaggggtttcaatatagcgatagacggtggtgcttcgacggcgaacgcaacaatcaggtgctggaggaaaacatggatgtcgagatttggacaaaggagggagaacgcaaaaagctccggcccagatggctggacgctcgcacctactccgaccctcttgccctgcgggagtttaaagagttcgctgccggcagacgctctgtgagcggggatctcatcctggagattggaaagctgccccagcacctcacacagcgggcgcaaaatgcccttgacaacctggttatgctgcataattccgaacagggcgggagagcttatcggcacgccatggaggagctccctgataccatcgaaacactgatgcttctggctctcattgccgtgctgaccggaggcgtgacgctgtttttcctctctggccgcgggcttggaaagacaagcatcggcctgctgtgtgtcatggcctccagcgttctcctgtggatggcttctgtggagccccattggatcgcggcctccattatccttgaatttttcctgatggtgctcctgattccggagcctgacagacagcggacaccccaggataaccaactggcttacgtcgtgatcgggctcctttttatgattctgaccgttgccgccaatgagatgggactgctcgaaacaaccaaaaaggacctgggcatcgggcacgaggctgtgggaaaccaccatcacgccgcgatgcttgatgtcgacctgcatcctgccagcgcttggacactctacgccgtggctacgaccattatcacacccatgatgcgccacaccatcgaaaacacaaccgccaatatttctctgacggcgatcgccaaccaggctgccattctgatgggcctcgataaaggctggcctatctccaagatggacattggggtcccccttctggctctgggatgctatagccaggtgaatccgctcaccctgacagccgctgttcttatgctggtggcccattacgcgatcatcggccctgggctccaagccaaagctaccagagaggcccagaagcggacagctgccggaattatgaagaaccccaccgtcgatggcatcgtggccattgacctggatcccgttgtgtatgacgcgaaattcgaaaagcagctggggcagatcatgctccttattctgtgtacgtctcaaatcctgctcatgcgcacaacctgggctctgtgcgagagcatcacacttgccaccggacctctgaccacactctgggagggctccccgggcaaattttggaatacgaccattgctgtctctatggccaacatcttcagagggagctacctggccggagctggcctggccttttccctcatgaaaagccttgggggaggccggcgcgggacaggagcgcagggcgaaaccctgggcgagaaatggaagagacagctgaatcagctctccaagtctgagttcaacacatataaacggagcgggattatggaggtggacagatccgaagccaaggagggactgaaacgcggcgagaccacgaagcacgctgtgtctcgggggacagccaaacttagatggttcgttgaacgcaatctggtcaagcccgagggaaaggtgatcgatctcggctgtgggcggggaggctggagctactattgcgctggcctgaaaaaggtgaccgaagtcaaagggtacaccaagggaggccctgggcacgaggaacccattcctatggccacatacggatggaacctggttaaactccattccggcaaggacgtgtttttcattccccctgagaaatgtgatacccttctgtgcgacattggggagtctagcccgaatcccacaatcgaagagggaagaacgctgcgcgtgctcaagatggtcgaaccttggctgcggggcaaccaattttgtatcaagattcttaatccctatatgccttccgtggttgagaccctggagcagatgcagagaaaacacggcgggatgctcgtgcgcaaccccctgagcagaaattctacacatgaaatgtactgggtctcctgcggaaccggcaacatcgtgagcgcggttaatatgacatctagaatgctgctcaaccgcttcaccatggcccaccggaagccgacgtatgagagagatgtggacctgggggctggaacccgccacgtcgccgtggaacctgaggtggctaaccttgatattatcggccagagaattgaaaatatcaaacatgagcacaagtccacatggcattacgacgaggataacccctataaaacctgggcctaccacgggagctatgaagtcaagccctctggatccgctagctccatggttaatggcgtggtgaagctgctcacaaaaccttgggacgtcatccccatggtgacccaaattgccatgacagataccacgccttttggccagcagcgggttttcaaggagaaagtggacacacgcaccccgaaggcgaaaagagggaccgcccaaatcatggaagtcacagctaagtggctgtggggatttcttagccggaacaagaaacccagaatttgtacgcgggaggagttcacccgcaaggtgagatctaatgccgctatcggcgccgtttttgtggacgagaaccagtggaatagcgccaaagaggcggtcgaagatgagcggttctgggacctggtgcatcgcgaaagagagctccacaagcaggggaaatgcgctacatgcgtttacaacatgatgggaaagcgggaaaagaaactgggcgagtttgggaaggccaaaggctcccgcgccatttggtacatgtggctgggagctagattcctcgagtttgaagccctgggcttcatgaatgaggatcactggttctctcgggaaaacagcctttccggggtggagggagagggcctgcataagctcgggtatatcctgcgcgacatctctaaaattcctggaggcaatatgtacgctgatgacaccgccgggtgggatacaagaatcaccgaagacgatcttcagaacgaggcgcggattacagacatcatggaacccgagcacgccctgctcgctaagagcatttttaaactgacctatcaaaataaggtcgtgcgcgtccagagacctgccaagaacggcacggtgatggatgttatctcccggcgcgaccagagaggatctggccaggtggggacctacggactgaatacattcaccaacatggaagctcaactcatccggcagatggagagcgagggcatcttttcccccagcgaactggagacaccgaaccttgccgaaagagtcctggattggctcgagaaatatggggtggaacgcctgaagcggatggcgatctctggagacgactgtgtggttaaacctattgatgacagattcgccaccgctcttacggccctgaatgatatgggcaaggtgcgcaaagacatcccccagtgggagccttccaaggggtggaacgattggcagcaagtccccttttgcagccatcacttccaccagctcattatgaaggacggccgggagatcgtggttccttgtagaaatcaggatgaactggtgggacgcgctcgggtctctcagggcgccgggtggtccctgagagagacagcttgcctcggaaaaagctacgcccaaatgtggcagctgatgtattttcatcgccgggaccttagactggcggccaacgctatttgttccgccgtgcccgtcgattggatcccgacctctcgcacaacctggagcatccacgcccatcaccagtggatgacgaccgaagacatgctctccgtgtggaatcgggtttggattgaggaaaacccttggatggaggataagacacatatcagctcttggggcgacgtgccctacctggggaaaagagaggaccaatggtgcggatcccttattggcctgaccgctcgggccacatgggcgaccaatatccaggtcgctattaaccaggtgagacgcctcatcgggaatgaaaactacctggattatatgacaagcatgaagcggttcaaaaatgagtctgaccccgaaggcgccctgtggtga

SEQ ID NO: 18539 - RNA, 9879 nt, synthetic construct
  misc_feature 1..9879: note = derived and/or modified CDS sequence (opt5) from DENV-1__GQ868637__SS-prME
  source 1..9879: mol_type = other RNA
agcgtgaccatgctgctcatgctgatgcccacagcccttgctttccacctgacgacccggggcggggaacctcatatgatcgtctccaagcaggaacggggaaaatctctcctgtttaagaccagcgccggcgttaatatgtgcacccttattgccatggacctgggggaactctgtgaagatacaatgacctacaaatgcccgagaatcacagaagtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaaacagattcagcgggtggaaacatgggccctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaggacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctacctctgagatccagctcacagactacggcgccctgaccctggattgtagcccccggacaggcctcgacttcaacgaaatggtcctgcttaccatgaaggagaaaagctggctggtgcataagcagtggtttctcgatctgcctcttccctggacgtccggggcctctacaagccaagagacctggaatcgccaggacctgctcgtcacattcaaaaccgctcacgcgaagaagcaggaagtggttgtgctgggatcccaagagggcgccatgcacaccgctctgacaggggccacggaaattcagaccagcggaacaaccacaatctttgccggccatctcaaatgcagactgaagatggataaacttaccctgaaggggatgtcttatgtcatgtgtacgggctccttcaaactcgagaaggaagtggctgagacacagcacggaaccgttctggtgcagattaagtacgagggcaccgacgccccgtgcaaaatccctttcagcacacaagatgaaaagggggtcacccagaacggacggctgatcacagcgaatcccattgtgacggacaaagagaagcctgtgaacatcgaagctgagccgccctttggcgagtcttatattgttatcggggccggagaaaaagcccttaagctcagctggttcaagaaaggctcctctattgggaagatgtttgaggctaccgccagaggcgctcgccggatggccatcctgggagatacagcgtgggacttcggcagcatcgggggagtctttacctccgtgggcaaactggtgcatcagattttcgggacagcctacggagtcctctttagcggcgtgtcttggaccatgaagatcgggattggcgttctgcttacgtggctgggactcaattccagaagcacctctctgtccatgacatgtatcgctgtgggcctggtcaccctttacctcggggtgatggttcaggccgatagcggatgcgtgattaactggaaaggccgcgaactgaagtgtgggtccggaatcttcgtcacaaatgaggtgcacacctggacagaacaatataagtttcaggctgactctcctaaacggctgagcgccgcgattggcaaggcctgggaggagggggtttgcggcatcagatccgctacccgcctcgaaaacatcatgtggcggcagatttctaacgagctgaatcatatccttctggaaaacgacatgaaattcacggtggtcgtgggagatgtggtcggcattctcgcccaggggaagaaaatgatcagaccgcaacccatggagcacaagtacagctggaaatcctggggaaaggctaagattatcggcgccgacgttcagaatacaacctttatcattgatgggcctaacacccccgaatgtcctgacgatcagcgcgcctggaatatctgggaggtggaggactatggattcggcatttttacaaccaacatctggctgaaactgcgggatagctacacgcaagtgtgcgaccacagacttatgtctgctgcgattaaggattccaaagccgtccatgctgacatgggctattggatcgaaagcgagaagaatgaaacatggaaactcgcccgcgcctctttcatcgaggtgaagacctgtatttggcccaagtcccacacactgtggagcaacggggttctggaatctgagatgatcattccgaaaatctacggaggccctattagccaacataattatcggcccgggtacttcacccagacagctggaccttggcacctcggcaagctggagcttgattttgacctgtgcgaagggaccacggtggtcgtggatgagcactgcggaaacagaggcccctccctccggaccacaaccgttacaggcaaaatcatccatgaatggtgttgccgcagctgtaccctgcctcccctgagattcaagggggaggacggatgctggtacggcatggagattcggccggtgaaagaaagagaggaaaatcttgtcaagtctatggtgtccgccgggagcggagaggttgactccttttctctcggcctgctgtgtatcagcattatgatcgaagaggtgatgcgctcccggtggtctagaaagatgctcatgacggggacactggcggtcttctttcttctgattatgggacagctcacctggaacgatctgatccgcctgtgcattatggtgggcgctaatgccagcgacagaatgggcatggggacaacctatcttgccctgatggctaccttcaaaatgcggcctatgtttgccgtgggactcctgttccgcagactcacatcccgggaggtcctgcttctgacgatcggcctctctctggttgcgagcgtggaactgcccaactcccttgaggaactgggggatggactcgctatgggcatcatgattctgaagctcctgaccgactttcaaagccaccagctttgggccacactgctctctctgaccttcatcaaaacaaccttttccctgcattacgcctggaagacgatggctatggtgcttagcattgtctctctgctccccctgtgtctctccacaaccagccagaaaaccacatggctgcctgtgcttctggggtctctgggatgcaagccgctcaccatgttcctgatcgccgagaataagatttggggccgcaaatcctggccccttaacgaaggcatcatggctgttgggatcgtgagcattctgctctccagcctgctcaagaacgatgtccctctggccggaccccttatcgcgggcgggatgctgattgcctgttatgtgatctctggaagctccgctgacctgtctctcgagaaagccgctgaggttagctgggaagaggaagccgagcactccggcgcctctcataatattctggtggaagtccaggatgacgggacaatgaagatcaaagatgaggagagagacgatacgcttaccatcctgctcaaggctacactgctcgcggtgagcggagtctaccctctgtccattcccgccaccctttttgtgtggtatttctggcagaagaagaagcagcggtctggcgttctgtgggacacaccttcccctcccgaagtggagcgcgctgtcctggatgacggcatctacagaattatgcagcgggggctcctgggacgctcccaggtgggcgttggggtgttccaagaaaacgtctttcacaccatgtggcacgtgacgagaggagccgtgcttatgtatcagggcaaacggctggagcccagctgggcctctgttaagaaagacctcatctcctacgggggaggctggagactgcagggcagctggaataccggggaggaagtccaggtgattgctgtggagcccggaaagaaccctaaaaatgtccaaacagcccccggcaccttcaagacaccggaaggggaggtgggagcgatcgctctcgattttaagcctggcacctctgggtcccccattgttaaccgcgaaggaaaaatcgtgggcctgtacggcaatggggtcgtgacaacgagcggaacctatgtttccgccatcgcccaggctaaggcctctcaggagggccctcttcccgagattgaagacgaggtgttccggaaaagaaacctgacaatcatggatctgcatcccgggagcggaaagacccgccggtacctccctgcgattgtcagagaagctatcaaacgcaagctgcggacccttattctggccccgacaagagtggttgcctccgagatggctgaagccctcaagggcatgcccatccgctatcaaacgaccgctgtgaaaagcgagcacacagggcgggagatcgtcgacctgatgtgccatgccacctttacaatgagactgctctctcctgtgcgggtgcccaattacaacatgattatcatggatgaagcgcacttcaccgacccttccagcattgccgctcgcggctatatctctacgagagtcggaatgggcgaggccgctgccatttttatgacagccacaccccctgggagcgttgaggctttcccgcagtccaatgcggtgatccaggatgaggaacgggacatccccgagcgctcttggaacagcggatacgagtggattaccgattttcctggcaagacagtgtggttcgtcccctccatcaaatctgggaatgacattgccaactgtcttagaaagaatggaaaacgggtgatccagctgagcagaaagacctttgatacagaatatcaaaagaccaaaaacaacgactgggactacgttgtgacgacagatatttccgagatgggcgctaatttccgcgccgaccgggtcatcgatcctagacgctgcctgaagcccgtgattctcaaagacgggccggaacgggttatcctggccggccctatgcccgtgaccgtcgctagcgccgcgcagagacgcggacggatcggcagaaaccataataaggagggggatcagtacatttatatgggacagccccttaacaatgacgaggatcacgctcactggacagaagccaaaatgctgctcgacaacatcaatacccctgagggcattatccccgccctgttcgaacctgagcgcgaaaagtctgctgccattgatggggagtacagactgcggggagaggcgcgcaagacgtttgtggaactcatgagacggggcgaccttccggtctggctgtcctataaagtggccagcgaggggttccaatactccgatcgcagatggtgctttgacggcgaacggaacaatcaggttctggaggaaaacatggatgtggagatctggaccaaggagggagaacgcaaaaagctccgcccccggtggctggacgctagaacatattctgaccctcttgccctgcgcgagttcaaagaatttgctgccggccggagaagcgtgtccggggatctcatcctggagattggaaagctgccccagcatctcacccagcgggctcaaaatgcccttgacaacctggtcatgctgcacaattctgaacagggcgggcgcgcgtacagacatgccatggaggagctccctgatacaatcgaaaccctgatgcttctggctctcattgccgttctgacaggaggcgtgaccctgttctttctcagcggccgggggcttggaaaaacgtccatcggcctgctgtgtgtgatggctagctctgccctcctgtggatggcctccgtcgagccccactggattgctgcgagcatcatccttgagttctttctgatggtgctcctgattccggagcctgaccgccagagaacaccccaggataaccaactggcctatgttgtgatcgggctccttttcatgattctgaccgtcgctgccaatgagatgggactgctcgaaaccacaaagaaggacctgggcatcgggcacgtggccgtcgagaaccatcaccatgctaccatgcttgatgtggacctgcaccctgcctctgcgtggacactctacgccgttgctacgaccattatcacacccatgatgcggcataccattgaaaacacaaccgccaatatctccctgacggctatcgccaaccaggcggccattctgatgggactcgataaaggctggcctatcagcaagatggacattggcgtgccccttctggctctggggtgctactctcaggtcaatccgctcaccctgatcgccgctgtgcttatgctggttgcccactatgctattatcggacctggcctccaagccaaagcgacacgcgaggcccagaagagaaccgctgccgggatcatgaaaaaccccacagtggatggaattgtcgctatcgacctggatcccgtggtgtacgacgccaagtttgaaaagcagctgggccagattatgctccttatcctgtgtaccagccaaattctgctcatgcggacgacatgggccctgtgcgagtccatcacccttgcgacagggcctctgaccaccctctgggagggatctccgggcaaattctggaatacaacgatcgctgttagcatggccaacatttttcgcggctcctatctggctggggccggactggccttcagcctcatgaagtcccttggcgggggaagacggggcaccggggctcagggagaaacactgggcgagaaatggaagagacagctgaatcagctctctaaaagcgagttcaacacctacaagcgctccggcatcatggaggtcgaccggtctgaagccaaggaggggctgagacgcggagagacaaccaaacacgcggtgagccggggcacggccaaacttagatggtttgtggaacgcaatctggtcaaacccgaggggaaggttattgatctcggatgtggcagagggggatggtcctattactgcgctggcctgaaaaaggtgacagaagtgaagggctataccaaagggggacctggccatgaggaacccatccctatggccacctacgggtggaacctggtcaagctccactctggaaaagacgtgttctttattccccctgagaagtgtgatacacttctgtgcgacatcggcgagagctccccgaatcccaccattgaagaggggagaacactgcgcgttctcaaaatggtggaaccttggctgcggggaaaccaattctgtatcaagatccttaatccctacatgcctagcgtcgtggagacgctggagcagatgcagagaaaacatggcggcatgctcgttcgcaaccccctgtctagaaattccacccacgaaatgtattgggtgagctgcgggacaggaaacattgtctctgctgtgaatatgacctccagaatgctgctcaaccgctttacaatggcccacagaaagccgacctacgagcgggatgtggacctgggcgcggggacgcgccatgtcgccgttgaacctgaggtggctaaccttgatatcattggacagagaatcgaaaatattaagcacgagcataaaagcacctggcactatgacgaggataacccctacaagacatgggcctatcatggctcttacgaagtgaaaccctccgggagcgcttccagcatggtcaatggagtggttaagctgctcaccaaaccttgggacgtgatccccatggtcacacaaatcgccatgaccgatacaacccctttcggccagcagcgggtgtttaaggagaaggttgacacgagaacaccgaaagctaagcggggcaccgcccaaattatggaagtgaccgcgcgctggctgtgggggttcctttctagaaacaaaaagccccggatctgtacacgcgaggaatttacgagaaaagtccggagcaatgccgctattggagccgtgttcgttgacgagaaccagtggaactccgctaaggaggccgtggaagatgagcgcttttgggacctggtccacagagaacgggagctccacaagcagggcaaatgcgcgacctgcgtgtataacatgatggggaagcgcgagaaaaagctgggagagttcggcaaagcgaaggggtctagagctatctggtacatgtggctgggcgcccggtttctcgagttcgaagccctgggattcatgaatgaggatcattggtttagccgcgaaaactccctttctggcgtcgagggggagggactgcacaagctcggctacattctgagagacatcagcaaaatccctgggggaaatatgtatgctgatgacacagccggctgggatacccggattacagaagacgatcttcagaacgaggctaagatcaccgacattatggaacccgagcatgccctgctcgcgacatccatcttcaaactgacctaccaaaataaggtggttcgcgtgcagagacctgccaaaaacgggacggtcatggatgtgatttctcggagagaccagcgcggcagcggacaggtgggcacctatgggctgaatacatttaccaacatggaagctcaactcatccggcagatggagtccgagggaatcttcagcccctctgaactggagacaccgaaccttgccgaaagagttctggattggctcgagaagtacggcgtggaacgcctgaaacggatggctatttccggggacgactgtgtcgtgaagcctatcgatgacagatttgccaccgcgcttacggccctgaatgatatgggaaaggttcgcaaagacattccccagtgggagcctagcaagggctggaacgattggcagcaagtgcccttctgctctcaccactttcatcagctcatcatgaaagacgggcgggagattgtcgtgccttgtagaaatcaggatgaactggtcggccgcgctcgggtgtcccagggagccggctggagcctgagagagacagcttgcctcgggaagtcctatgcccaaatgtggcagctgatgtacttccaccgccgggaccttagactggctgccaacgcgatctgttctgccgttcccgtggattgggtcccgaccagccggacaacctggtccattcatgctcaccatcagtggatgacgaccgaagacatgctcagcgtgtggaatagagtttggatcgatgagaacccttggatggaagacaaaacacacatctcttcctggggagacgtgccctatctgggcaagcgcgaggatcaatggtgcgggagccttattggactgaccgcccgggccacatgggctaccaatatccaggtcgccattaaccaggtgagacgcctcatcggcaatgagaactacctggactacatgacatctatgaagagatttaaaaatgaaagcgatcccgagggggcgctgtggtga

SEQ ID NO: 18540 - RNA, 9879 nt, synthetic construct
  misc_feature 1..9879: note = derived and/or modified CDS sequence (opt5) from DENV-1__GQ868639__SS-prME
  source 1..9879: mol_type = other RNA
tccgtgaccatgctgctcatgctgatgcccacggcccttgctttccacctgacgaccagaggcggggaacctcatatgatcgtctccaagcaggaacggggaaaatctctcctgtttaagacaagcgccggcgttaacatgtgcacccttattgccatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcgctgacttccaatctcatcagctgtgggccacacttctgtccctcacgtttatcaaaaccacattcagcctgcactatgcttggaagaccatggccatggttctgtctattgtgtccctttttcccctgtgtctcagcacaacctctcagaagacgacatggctgcctgtgctcctggggtcccttggatgcaaaccgctgaccatgttcctgatcgcggagaataagatttggggcagaaaaagctggcccctcaacgaaggcatcatggccgtcgggatcgtgtccattctgcttagctctctgctcaagaacgatgttcctctggctggacccctcatcgccggcgggatgctgattgcttgttacgtgatcagcggatcctctgccgaccttagcctggagaaagccgctgaggtctcctgggaagaggaagcggagcattctggcgccagccacaatattctggtggaagttcaggatgacgggaccatgaagatcaaagatgaggagcgggacgatacactcaccatcctgcttaaggctacactgctcgccgtgtccggagtctatcctctgtctattcccgccacactcttcgtgtggtacttttggcaaaagaaaaagcagcgcagcggcgtcctgtgggacacccctagccctcccgaagtggagagagctgttcttgatgacggcatctatcggattatgcagcgcgggctgctgggaagaagccaggtgggcgtcggggtgttccaagaaaacgtttttcatacaatgtggcacgtgacccggggagccgtcctcatgtaccagggcaaacgcctggagccctcttgggcgtccgtgaagaaagaccttatcagctacgggggaggctggagactgcagggctcttggaatacaggggaggaagtgcaggttattgctgtcgagcccggaaagaaccctaagaatgtgcaaaccgcccccggcacgttcaaaacctccgaaggggaggtgggagccatcgctctcgattttaagccgggcacaagcgggtcccctattgtcaaccgggaaggaaaaatcgtgggcctgtatggcaatggggttgtgaccacatctggaacctacgtcagcgccatcgcgcaggctaaggcctcccaggagggccccctccctgagattgaagacgaggtgttcagaaaacgcaacctgacaatcatggatcttcaccccgggagcggaaagacgcggagatatctgcccgccattgttcgcgaagctatcaagcggaaactgagaaccctcattctggcccctacacgcgtggtcgcttctgagatggccgaagcgcttaagggcatgccgatccggtaccaaaccaccgccgtgaaatccgagcatacagggaaggagatcgttgacctgatgtgccacgctacgtttaccatgagactcctgagccccgtgcgcgtccctaattataacatgattatcatggatgaagcccatttcacagacccctctagcattgctgcccggggctacatctccaccagagtgggaatgggcgaggccgctgcgatttttatgacagccacccctcccgggtctgctgaagccttccctcagagcaatgccgtgatccaggatgaggaacgggacatcccggagcgctcctggaactctggatatgagtggattacggattttcccggcaaaacagtctggttcgttcctagcatcaagtccgggaatgacattgctaactgtctgagaaagaatggaaaacgggtgatccagctcagccgcaagaccttcgataccgaataccagaagaccaagaacaacgactgggactacgtggtcaccacagatatttctgagatgggcgccaattttagagcggaccgggtgatcgatcccagacgctgccttaaacctgttattctgaaggacgggcccgaacgggtgatcctggctggcccgatgcctgtcaccgtggcctccgccgctcagagacgcggacggatcggcagaaaccacaataaggagggggatcagtatatttacatgggacagcccctcaacaatgacgaggatcatgcccactggacggaagcgaaaatgctgcttgacaacatcaatacacccgagggcattatccctgccctgttcgaacccgagcgcgaaaagagcgctgccattgatggggagtatcggctcagaggagaggctcgcaaaacctttgttgaactgatgagacggggcgacctgcctgtgtggctctcctacaaggtcgcctctgaggggttccaatatagcgatcgcagatggtgctttgacggcgaacggaacaatcaggtgcttgaggaaaacatggatgtcgagatctggacaaaagagggagaacgcaagaaactgagaccgcggtggctggacgctagaacctactccgaccccctcgccctgcgcgagttcaaggaatttgcggccggccggagatctgtgagcggggatcttatcctggagattggaaagctccctcagcacctgacgcagcgcgctcaaaatgccctggacaacctcgttatgcttcataattccgaacagggcgggcgggcttatagacacgccatggaggagctgcccgataccatcgaaacactgatgctcctggcccttattgctgtgctgaccggaggcgtgacactcttctttctgagcggccgggggctgggaaaaacctctatcggcctcctttgtgtcatggcgtccagcgttctgctgtggatggcctctgtggagcctcattggattgctgcctccatcatcctcgagttctttctgatggtgcttctgattcccgagccggaccgccagagaacacctcaggataaccaactcgcctacgtcgtgatcgggctgctgttcatgattctcaccgttgctgccaatgagatgggacttctggaaacgacaaagaaagacctgggcatcgggcacgtggcggtcgagaaccaccatcacgccgctatgctcgatgtggacctgcatcccgccagcgcttggaccctttacgccgtcgcgaccacaattatcacccctatgatgcggcacacaattgaaaacacgaccgccaatatctctctgacagctatcgccaaccaggctgccattctcatgggactggataagggctggcccatcagcaaaatggacattggcgtgcctctgctcgctcttgggtgctattcccaggttaatcccctgaccctgacagccgcggtgctcatgctggtcgcccattacgctatcattggaccgggccttcaagccaaggctacccgcgaggcccagaagagaacggccgcggggatcatgaaaaaccctaccgtggatggaatcgttgctattgacctggatcccgtggtctatgacgccaagtttgaaaaacagctcggccagatcatgctgctgattctctgtacatctcaaatccttctgatgcggaccacatgggctctgtgcgagagcattaccctcgccacggggcccctgacaaccctttgggagggatcccctggcaagttctggaatacaaccatcgccgtgagcatggctaacatcttccgcggctcctacctggccggggcgggactcgccttttctctgatgaaaagcctgggcgggggaagacggggcaccggggctcagggagaaacactcggcgagaagtggaagcgccagcttaatcagctgtccaaatctgagttcaacacgtataagagaagcggcattatggaggtggaccggtccgaagccaaagaggggctgaagagaggagagaccacaaaacacgctgtttctcgcggcaccgccaagctccggtggtttgtcgaaagaaatctggtgaagccggaggggaaagtgatcgatcttggatgtggccgcgggggatggagctactattgcgcgggcctgaagaaagtcacagaagttaagggctacaccaaagggggacccggccacgaggaacctattcccatggccacgtacgggtggaacctcgtgaagctgcattccggaaaagacgtgttctttgtccctcccgagaagtgtgatacactgctctgcgacatcggcgagagctctcctaatccgaccattgaagaggggcggacccttagagtgctgaagatggttgaaccctggctgcgcggaaaccaattctgtatcaaaattctcaatccttatatgccctccgtggtcgagacactggagcagatgcagcggaagcacggcggcatgcttgtgagaaaccctctgagccgcaattctacccatgaaatgtactgggtttcctgcgggacaggaaacatcgtgagcgctgtcaatatgacgtctcggatgctcctgaacagatttaccatggcccaccgcaaacccacatatgagcgggatgtggacctgggcgctgggaccagacacgtggccgtcgaaccggaggttgctaacctcgatatcattggacagcgcatcgaaaatattaagcatgagcacaaatccacatggcattacgacgaggataacccttataagacctgggcctaccacggcagctatgaagtgaagccctccgggagcgcgtctagcatggtgaatggagtcgtgaaactgcttacgaagccctgggacgttatccctatggtgacccaaattgccatgacagataccacacccttcggccagcagagagtctttaaagagaaggtggacacccggacacctaaagctaagcgcggcaccgcccaaatcatggaagttacggctaagtggctgtgggggttcctctccagaaacaaaaagccgcggatctgtacaagagaggaatttacccggaaagtgcgctctaatgccgccattggagcggtcttcgtggacgagaaccagtggaatagcgctaaggaggccgttgaagatgagagattttgggacctggtgcatcgggaacgcgagcttcacaaacagggcaagtgcgcgacctgcgtctacaacatgatggggaagagagagaagaagctgggagagttcggcaaagctaaggggtcccgggccatctggtacatgtggctcggcgctcgcttcctggagtttgaagccctgggattcatgaatgaggatcactggttttctagagaaaacagcctctccggcgtggagggggagggactgcataaacttggctatattctgcgggacatctctaagattagcgggggaaatatgtacgcggatgacacagccggctgggatacgcgcatcaccgaagacgatctccagaacgaggctaaaatcacagacattatggaacccgagcacgccctgcttgctaagtccatcttcaagctgacctatcaaaataaagtcgtgagagttcagcggcctgccaagaacgggacagtgatggatgtcattagccgcagagaccagcggggctctggacaggtgggcacctacgggctcaatacatttaccaacatggaagcgcaactgatccgccagatggagtccgagggaattttcagcccctctgaactggagacgcctaacctcgccgaaagagctctggattggcttgagaaacatggcgtggaacggctgaagagaatggccatctccggggacgactgtgttgtgaaacccatcgatgaccgctttgctaccgccctcacagctctgaatgatatgggaaaggtccggaaggacattccgcagtgggagcctagcaaaggctggaacgattggcagcaagtgcccttctgctcccaccactttcatcagcttatcatgaaggacgggagagagattgttgtgccttgtcgcaatcaggatgaactggtcggccgggccagagtgtctcagggagcgggctggagcctccgcgagaccgcctgcctggggaaatcctatgctcaaatgtggcagctgatgtacttccaccggagagacctccgcctggccgccaacgctatctgtagcgccgtccccgtggattgggttcctacatctcggaccacgtggtccattcatgcgcaccatcagtggatgacaaccgaagacatgcttagcgtgtggaatagagtctggatcgaggaaaacccctggatggaggataagacacacatttctagctgggaggacgtgccgtatctgggaaaacgcgaagaccaatggtgcggctccctcatcgggctgaccgctcgggccacgtgggccaccaatatccaggttgctattaaccaggtgagacggcttatcggaaatgagaactacctggattacatgacatctatgaagagatttaagaatgaaagcgaccctgagggcgccctctggtga

SEQ ID NO: 18541 - RNA, 9879 nt, synthetic construct
  misc_feature 1..9879: note = derived and/or modified CDS sequence (opt5) from DENV-1__GU131925__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgagaccacgaaacacgctgtttctagagggacagccaaacttcgctggtttgtcgagcggaatctggtgaaacccgaaggaaaggtgattgatctcggctgtgggagaggaggctggagctactattgcgctggcctgaagaaagtcaccgaggttaaggggtacaccaaaggaggccctgggcacgaagaacccatccctatggccacatacggatggaacctggtgaagctccattccggcaaagacgtgttctttattccccctgaaaagtgtgatacccttctgtgcgacatcggggagtctagcccgaatcccacaattgaggaaggacgcacgctgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgcggtgaatatgacatctcgcatgctgctcaaccggtttaccatggcccacagaaaaccgacgtatgaacgcgatgtcgacctgggggctggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagcgcgtgtttaaagaaaaggtcgacacaagaaccccgaaagcgaagcgggggaccgcccaaattatggaggtgacagctaaatggctgtggggattccttagcagaaacaagaagccccggatctgtacgcgcgaagagtttaccagaaaagttcggtctaatgccgctattggcgccgtgttcgtcgacgaaaaccagtggaatagcgccaaggaggcggtggaggatgaacgcttttgggacctggttcatagagagcgggaactccacaaacaggggaagtgcgctacatgcgtgtacaacatgatgggaaaacgcgagaagaagctgggcgagttcgggaaagccaagggctccagagccatctggtacatgtggctgggagctcggtttctcgagttcgaggccctgggcttcatgaatgaagatcactggttttctcgcgagaacagcctttccggggtcgaaggagagggcctgcataaactcgggtatattctgagagacatctctaagatccctggaggcaatatgtacgctgatgacaccgccgggtgggatacacggattaccgaggacgatcttcagaacgaagcgcgcatcacagacattatggagcccgaacacgccctgctcgctaaaagcatcttcaagctgacctatcaaaataaagtggtcagagtgcagcggcctgccaagaacggcacggttatggatgtgatttcccgcagagaccagcggggatctggccaggtcgggacctacggactgaatacatttaccaacatggaggctcaactcatcagacagatggaaagcgagggcatcttctcccccagcgagctggaaacaccgaaccttgccgagcgcgtgctggattggctcgaaaagtatggggtggagcggctgaaaagaatggcgatttctggagacgactgtgttgtgaagcctatcgatgaccgctttgccaccgctcttacggccctgaatgatatgggcaaagtccggaaggacattccccagtgggaaccttccaaagggtggaacgattggcagcaagtgcccttctgcagccatcactttcaccagctcatcatgaaggacggcagagagattgttgtgccttgtcgcaatcaggatgagctggtcggacgggctagagtgtctcagggcgccgggtggtccctgcgcgaaacagcttgcctcggaaagagctacgcccaaatgtggcagctgatgtatttccatcggagagaccttcgcctggcggccaacgctatctgttccgccgtccccgtggattggattccgacctctcggacaacctggagcatccacgcccatcaccagtggatgacgaccgaggacatgctctccgtttggaatagagtgtggatcgaagagaacccttggatggaagataaaacacatattagctcttggggcgacgtcccctacctggggaagcgggaggaccaatggtgcggatcccttatcggcctgaccgctagagccacatgggcgaccaatattcaggtggctatcaaccaggttcgccggctcattgggaatgagaactacctggattatatgacaagcatgaaaagatttaagaatgaatctgaccccgagggcgccctgtggtga

SEQ ID NO: 18542 - RNA, 9879 nt, synthetic construct
  misc_feature 1..9879: note = derived and/or modified CDS sequence (opt5) from DENV-1__GU131926__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaagtctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgtcgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggagttaatagcagatctacgtccctgagcatgacctgtatcgccgtgggcctcgtcacactgtacctgggggtgatggttcaggctgattccggatgcgtgattaactggaaaggccgcgaacttaagtgtgggtctggaatctttgtcaccaatgaggtgcacacatggaccgaacaatataagttccaggccgacagccctaaacggctctccgcggccattggcaaggcttgggaggagggggtttgcggcatcagatctgccacacgcctggaaaacatcatgtggaaacagattagcaacgagctgaatcatatcctcctggaaaacgacatgaagtttaccgtggtcgtgggagatgtggctggcattcttgcccaggggaaaaagatgatccggccgcaacccatggagtacaaatattcctggaaaagctggggaaaggccaagattatcggcgctgacgtccagaatacgacattcatcattgatgggcctaacacccccgaatgtcctgacgatcagagagcgtggaatatctgggaggttgaggactacggatttggcattttcaccacaaacatctggctgaagctccgcgattcttatacccaggtgtgcgaccaccggctgatgtccgccgctattaaagatagcaaggccgtgcacgccgacatgggctactggatcgaatctgagaaaaatgaaacgtggaagctggctagagcctccttcatcgaggtcaagacatgtatttggcccaaaagccataccctttggtctaacggggtgctcgaaagcgagatgatcattccgaagatctatggaggccctatttcccaacacaattaccgccccgggtactttacacagaccgcgggaccttggcatctgggcaaactggagctcgatttcgacctgtgcgaagggacaaccgttgtggtcgatgagcactgcggaaaccggggccccagccttagaacgaccacagtgaccggcaagatcatccacgaatggtgttgccggtcttgtacactgcctcccctccgctttaaaggggaggacggatgctggtatggcatggagattagaccggttaaggaaaaggaggaaaatctggtgaaatccatggtcagcgctgggtccggagaggtggactctttcagcctgggccttctctgtatctccattatgatcgaagaggttatgcggtctagatggagccgcaagatgctgatgaccgggacgctggccgtgtttttcctcctgattatgggacagcttacatggaacgatctgatccggctctgcattatggtcggcgccaatgcttccgacagaatgggcatggggatgacctacctggccctgatggcgacatttaaaatgcgccctatgttcgctgtgggacttctgtttagacggctcacctctcgcgaggtgctgctcctgaccatcggccttagcctggtcgcctccgttgaactccccaacagcctggaggaactgggggatggacttgccatgggcatcatgattctgaagctcctgacagacttccaatctcatcagctctgggctacgctgctttccctgacctttatcaaaacaaccttcagcctccactatgcctggaagacaatggctatggtgctgtctattgtgtccctgtttcccctttgtctgagcaccacgtctcagaagacaacctggctccctgtcctgctcgggtccctgggatgcaaaccgcttaccatgttcctgatcgccgagaataagatttggggcagaaaaagctggcccctgaacgaaggcatcatggcggtggggatcgtttccattctcctgagctctcttctgaagaacgatgtgcctctcgccggacccctgatcgctggcgggatgctcattgcctgttacgtcatcagcggatcctctgctgacctgagccttgagaaagccgccgaggtgtcctgggaagaggaagctgagcattctggcgcgagccacaatattctggttgaagtgcaggatgacgggacaatgaagatcaaagatgaggagcgggacgataccctgacaatcctcctgaaggccacgcttctggctgtctccggagtgtatcctctctctattcccgccaccctgttcgtctggtacttttggcaaaagaaaaagcagcgcagcggcgtgctctgggacacacctagccctcccgaagttgagagagccgtgctggatgacggcatctatcggattatgcagcgcgggcttctgggaagaagccaggtcggcgtgggggttttccaagaaaacgtgtttcataccatgtggcacgtcacacggggagctgtgctgatgtaccagggcaaacgcctcgagccctcttgggcctccgtgaagaaagacctgatcagctacgggggaggctggagacttcagggctcttggaataccggggaggaagttcaggtcattgcggtggagcccggaaagaaccctaagaatgtgcaaacggctcccggcaccttcaaaacatccgaaggggaggtcggagccatcgccctggattttaagccgggcaccagcgggtcccctattgtgaaccgggaaggaaaaatcgttggcctctatggcaatggggtggtcacaacctctggaacatacgtgagcgctatcgcccaggcgaaggcttcccaggagggccccctgcctgagattgaagacgaggttttcagaaaacgcaacctcacgatcatggatctgcaccccgggagcggaaagacccggagatatcttcccgccattgtgcgcgaagccatcaagcggaaactgagaacactgattctcgctcctacccgcgtcgtggcctctgagatggctgaagccctgaagggcatgccgatccggtaccaaaccacagcggttaaatccgagcatacggggaaggagatcgtggaccttatgtgccacgccacctttacaatgagactgctcagccccgtccgcgtgcctaattataacatgattatcatggatgaagctcatttcaccgacccctctagcattgccgctcggggctacatctccacaagagtgggaatgggcgaggccgccgctatttttatgaccgcgacgcctcccgggtctgccgaggctttccctcagagcaatgccgtcatccaggatgaagaacgggacatcccggagcgctcctggaactctggatatgagtggattacagattttcccggcaaaaccgtttggttcgtgcctagcatcaagtccgggaatgacattgccaactgtctgagaaagaatggaaaacgggtgatccagctgagccgcaagaccttcgatacagaataccagaagaccaagaacaacgactgggactacgtcgtgacaaccgatatttctgagatgggcgctaattttagagccgaccgggttatcgatcccagacgctgcctcaaacctgtgattcttaaggacgggcccgaacgggtcatcctggcgggcccgatgcctgtgacggttgcttccgccgcccagagacgcggacggatcggcagaaaccacaataaggagggggatcagtatatttacatgggacagcccctgaacaatgacgaggatcatgctcactggacagaagccaaaatgctcctggacaacatcaatacccccgagggcattatccctgcgcttttcgaacccgagcgcgaaaagagcgccgctattgatggggagtatcggctgagaggagaggcccgcaaaacatttgtggaactcatgagacggggcgacctgcctgtctggctgtcctacaaggtggcttctgaggggttccaatatagcgatcgcagatggtgctttgacggcgaacggaacaatcaggtcctcgaggaaaacatggatgtggagatctggaccaaagagggagaacgcaagaaacttagaccgcggtggctggacgccagaacgtactccgaccccctggctctccgcgagttcaaggaatttgccgcgggccggagatctgttagcggggatctgatccttgagattggaaagctgcctcagcacctcacccagcgcgcccaaaatgctctggacaacctggtgatgctccataattccgaacagggcgggcgggcctatagacacgctatggaggagcttcccgatacaatcgaaaccctgatgctgctcgccctgattgccgtgcttacaggaggcgtcaccctgttctttctcagcggccgggggctgggaaaaacatctatcggcctgctctgtgttatggcttccagcgtgcttctgtggatggcgtctgtggagcctcattggattgccgcttccatcatcctggagttctttctcatggtcctgcttattcccgagccggaccgccagagaacccctcaggataaccaactggcctacgtggttatcgggctcctgttcatgattctgacggtggccgctaatgagatgggactccttgaaacaaccaagaaagacctgggcatcgggcacgtcgccgtggagaaccaccatcacgcggccatgctggatgtcgacctccatcccgctagcgcctggaccctgtacgctgtggccacaaccattatcacacctatgatgcggcacacgattgaaaacaccacagcgaatatctctcttaccgccatcgctaaccaggccgctattctgatgggactcgataagggctggcccatcagcaaaatggacattggcgttcctctgctggccctcgggtgctattcccaggtgaatccccttacactgaccgctgccgtcctgatgctcgtggcgcattacgccatcattggaccgggcctgcaagctaaggccacgcgcgaggctcagaagagaaccgccgccgggatcatgaaaaaccctacagttgatggaatcgtggcgattgaccttgatcccgtcgtgtatgacgctaagtttgaaaaacagctgggccagatcatgctcctgattctgtgtacctctcaaatcctccttatgcggacaacctgggccctgtgcgagagcattacgctggctacagggcccctcaccacactgtgggagggatcccctggcaagttctggaataccaccatcgccgtgagcatggccaacatcttccgcggctcctaccttgctggggccggactggcgttttctctcatgaaaagcctgggcgggggaagacggggcacaggggcccagggagaaacgctgggcgagaagtggaagcgccagctcaatcagctttccaaatctgagttcaacacctataagagaagcggcattatggaggttgaccggtccgaagctaaagaggggctgaagagaggagagacaaccaaacacgccgtctctcgcggcacagctaagctgcggtggtttgtggaaagaaatctcgtgaagccggaggggaaagtcatcgatctgggatgtggccgcgggggatggagctactattgcgccggccttaagaaagttaccgaagtgaagggctacacgaaagggggacccggccacgaggaacctattcccatggcgacatacgggtggaacctggtgaagctccattccggaaaagacgtcttctttgtgcctcccgagaagtgtgataccctgctgtgcgacatcggcgagagctctcctaatccgaccattgaagaggggcggacactcagagttcttaagatggtggaaccctggctgcgcggaaaccaattctgtatcaaaattctgaatccttatatgccctccgtcgtggagaccctcgagcagatgcagcggaagcacggcggcatgctggttagaaaccctcttagccgcaattctacacatgaaatgtactgggtgtcctgcgggacgggaaacatcgtcagcgccgtgaatatgacctctcggatgctgctcaacagatttacaatggctcaccgcaaacccacctatgagcgggatgtggacctgggcgccgggacaagacacgtcgctgttgaaccggaggtggccaacctggatatcattggacagcgcatcgaaaatattaagcatgagcacaaatccacctggcattacgacgaggataacccttataagacgtgggcttaccacggcagctatgaagtgaagccctccgggagcgcctctagcatggtcaatggagtggttaaactcctgaccaagccctgggacgtgatccctatggtcacacaaattgcgatgaccgatacaacccccttcggccagcagagagtgtttaaagagaaggttgacacacggacccctaaagccaagcgcggcacggctcaaatcatggaagtgacagccaagtggctttgggggttcctgtccagaaacaaaaagccgcggatctgtaccagagaggaatttacccggaaagtccgctctaatgctgccattggagccgtgttcgttgacgagaaccagtggaatagcgcgaaggaggctgtggaagatgagagattttgggacctcgtccatcgggaacgcgagctgcacaaacagggcaagtgcgccacatgcgtgtacaacatgatggggaagagagagaagaaacttggagagttcggcaaagccaaggggtcccgggctatctggtacatgtggctgggcgcccgcttcctcgagtttgaagctctgggattcatgaatgaggatcactggttttctagagaaaacagcctgtccggcgtcgagggggagggactccataaactgggctatattcttcgggacatctctaagattagcgggggaaatatgtacgccgatgacacggcgggctgggatacccgcatcacagaagacgatctgcagaacgaggccaaaatcaccgacattatggaacccgagcacgctctcctggccaagtccatcttcaaacttacatatcaaaataaagtggttagagtgcagcggcctgctaagaacgggaccgtcatggatgtgattagccgcagagaccagcggggctctggacaggtgggcacatacgggctgaatacctttacgaacatggaagcccaactcatccgccagatggagtccgagggaattttcagcccctctgaactggagacccctaacctggcggaaagagccctcgattggctggagaaacatggcgttgaacggcttaagagaatggctatctccggggacgactgtgtggtcaaacccatcgatgaccgctttgccacagctctgaccgccctcaatgatatgggaaaggtgcggaaggacattccgcagtgggagcctagcaaaggctggaacgattggcagcaagttcccttctgctcccaccactttcatcagctgatcatgaaggacgggagagagattgtggtcccttgtcgcaatcaggatgaacttgtgggccgggctagagtctctcagggagccggctggagcctgcgcgagacagcgtgcctcgggaaatcctatgcccaaatgtggcagctgatgtacttccaccggagagacctgcgcctcgctgccaacgccatctgtagcgctgtgcccgttgattgggtgcctacctctcggacgacatggtccattcatgcccaccatcagtggatgaccacagaagacatgctgagcgtctggaatagagtgtggatcgaggaaaacccctggatggaggataagacccacatttctagctgggaggacgttccgtatcttggaaaacgcgaagaccaatggtgcggctccctgatcgggctcacggcgcgggctacctgggccacaaatatccaggtggccattaaccaggtcagacggctgatcggaaatgagaactaccttgattacatgacctctatgaagagatttaagaatgaaagcgaccctgagggcgctctgtggtga

SEQ ID NO: 18543 - RNA, 9879 nt, synthetic construct
  misc_feature 1..9879: note = derived and/or modified CDS sequence (opt5) from DENV-1__FJ639669__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttattgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcaccggcgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggcccaggggaaaaagatgatccggccgcaacccatggagtacaaatattcttggaaaagctggggaaaggccaagattatcggcgctgacgtgcagaataccaccttcatcattgatgggcctaacacacccgaatgtcctgacgatcagagagcgtggaatatctgggaggtcgaggactacggatttggcattttcaccacgaacatctggctgaaacttcgcgattcctatacacaggtttgcgaccaccggctcatgagcgccgctattaaagattctaaggccgtgcacgccgacatgggctactggatcgaatccgagaaaaatgaaacctggaagctggctagagccagctttatcgaggtgaagacatgtatttggcccaaatctcataccctgtggtccaacggggtcctcgaaagcgagatgatcattccgaagatctatggaggccctatttctcaacacaattaccgccccgggtacttcacacagaccgcgggaccttggcatctgggcaaacttgagctggatttcgacctctgcgaagggacgaccgtggttgtggatgagcactgcggaaaccggggccccagcctgagaacaaccacagtcaccggcaagatcatccacgaatggtgttgccggtcctgtacgctgcctccccttcgctttagaggggaggacggatgctggtatggcatggagattcggccggtgaaagaaaaggaggaaaatctcgttaagagcatggtgtctgctgggtccggagaggtcgacagcttctccctgggcctgctctgtatctctattatgatcgaagaggtgatgagaagccgctggtcccggaaaatgctgatgacagggacccttgccgtctttttcctgctcattatgggacagctgacatggaacgatctgatcagactttgcattatggtgggcgccaatgcttctgaccgcatgggcatggggaccacctacctggccctcatggcgacatttaagatgagacctatgttcgctgtcggactgctctttcggcgcctgacgagcagagaggtgcttctgctcaccatcggcctgtccctggtggcctctgtcgaacttcccaacagcctggaggaactcggggatggactggccatgggcatcatgattctcaaactgcttacagacttccaatcccatcagctgtgggctaccctcctgagcctgacatttatcaagaccacgttctctcttcactatgcctggaaaacaatggctatggttctgtccattgtgagcctctttcccctgtgtctctctaccacctcccagaagacaacctggctgcctgtgcttctggggagcctgggatgcaagccgctcacaatgttcctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttacgtgatcagcggatctagcgctgacctgtccctcgagaaggccgccgaggtctcttgggaagaggaagctgagcatagcggcgcgtcccacaatattctggtggaagttcaggatgacgggacgatgaaaatcaaggatgaggagcgcgacgatacccttacaatcctgctcaaagccaccctgctcgctgtgtctggagtctatcctctgagcattcccgccacactttttgtgtggtacttctggcaaaagaagaaacagagatccggcgtcctgtgggacaccccttctcccccggaagtggagcgggccgttctggatgacggcatctatcgcattatgcagagagggctcctgggacggagccaggtgggcgtcggggtgttccaagaaaacgtttttcatacgatgtggcacgtgacccgcggagctgtccttatgtaccagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacattcaagaccccggaaggggaggtgggagccatcgccctcgattttaaacctggcacaagcgggtctcccattgtcaacagagaaggaaagatcgtgggcctgtatggcaatggggttgtgacgacctccggaacatacgtcagcgctatcgcccaggcgaaggcttcccaggagggccctcttcccgagattgaagacgaggtgttccgcaagcggaacctgaccatcatggatctgcaccccgggtctggaaaaaccagacgctatctccctgccattgttcgggaagccatcaagagaaagctgcgcacacttattctggctccgacgcgggtggtcgccagcgagatggctgaagccctcaaaggcatgcccatcagataccaaaccacagcggtgaagtccgagcataccgggaaagagatcgttgacctgatgtgccacgccacatttaccatgcgcctgctcagccctgtgcgggtccccaattataacatgattatcatggatgaagctcatttcacggacccttcttccattgccgctagaggctacatcagcacacgggtgggaatgggcgaggccgccgctatttttatgaccgcgacaccccctgggtctgtggaagccttcccgcagagcaatgctgtcatccaggatgaggaacgcgacatccccgagagatcctggaactctggatatgagtggattacagattttcctggcaagaccgtttggttcgtgcccagcatcaaatccgggaatgacattgccaactgtcttcggaagaatggaaagcgcgtgatccagctgtctagaaaaacatttgataccgaataccaaaagacgaaaaacaacgactgggactacgtcgtgacaaccgatattagcgagatgggcgccaatttccgggctgacagagttatcgatcctcgccggtgcctgaagcccgtgattctcaaagacgggccggaaagagtcatcctggccggccctatgcccgtgacagttgcgtccgctgcccagcgccggggaagaatcggccgcaaccacaataaggagggggatcagtatatttacatgggacagccccttaacaatgacgaggatcatgcccactggaccgaagctaagatgctgctcgacaacatcaatacgcctgagggcattatccccgccctgttcgaacctgagcgggaaaagagcgcggccattgatggggagtatagactgcgcggagaggctagaaagacctttgtggagctcatgcggcgcggcgaccttccggtctggctgtcttacaaagtggcctccgaggggttccaatatagcgatagacggtggtgctttgacggcgaacgcaacaatcaggtcctggaggaaaacatggatgtggagatctggacaaaggagggagaacgcaaaaagctccggcccagatggctggacgctcgcacctactccgaccctcttgccctgcgggagttcaaagaatttgctgccggcagacgctctgttagcggggatctcatcctggagattggaaagctgccccagcacctcacacagcgggcgcaaaatgcccttgacaacctggtgatgctgcataattccgaacagggcgggagagcttatcggcacgccatggaggagctccctgataccatcgaaacactgatgcttctggctctcattgccgtgctgaccggaggcgtcacgctgttctttctctctggccgcgggcttggaaagacaagcatcggcctgctgtgtgttatggcctccagcgtgctcctgtggatggcttctgtggagccccattggattgcggcctccatcatccttgagttctttctgatggtcctcctgattccggagcctgacagacagcggacaccccaggataaccaactggcttacgtggttatcgggctccttttcatgattctgaccgtggccgccaatgagatgggactgctcgaaacaaccaaaaaggacctgggcatcgggcacgtcgctgtggagaaccaccatcacgccgcgatgcttgatgtcgacctgcatcctgccagcgcttggacactctacgccgtggctacgaccattatcacacccatgatgcgccacaccattgaaaacacaaccgccaatatctctctgacggcgatcgccaaccaggctgccattctgatgggactcgataaaggctggcctatctccaagatggacattggcgttccccttctggctctggggtgctatagccaggtgaatccgctcaccctgacagccgctgtccttatgctggtggcccattacgcgatcattggacctggcctccaagccaaagctaccagagaggcccagaagcggacagctgccgggatcatgaagaaccccaccgttgatggaatcgtggccattgacctggatcccgtcgtgtatgacgcgaaatttgaaaagcagctgggccagatcatgctccttattctgtgtacgtctcaaatcctgctcatgcgcacaacctgggctctgtgcgagagcattacacttgccaccgggcctctgaccacactctgggagggatccccgggcaaattctggaatacgaccatcgctgtgtctatggccaacatctttagaggcagctacctggccggggctggactggccttctccctcatgaaaagccttggcgggggacggcgcggcacaggggcgcagggagaaaccctgggcgagaaatggaagagacagctgaatcagctctccaagtctgagttcaacacatataaacggagcggcattatggaggttgacagatccgaagccaaggaggggctgaaacgcggagagaccacgaagcacgctgtctctcggggcacagccaaacttagatggtttgtggaacgcaatctggtgaagcccgaggggaaggtcatcgatctcggatgtggcagagggggatggagctactattgcgctggcctgaaaaaggttaccgaagtgaaaggctacaccaaagggggacctggccacgaggaacccattcctatggccacatacgggtggaacctggtgaaactccattccggaaaggacgtcttctttattccccctgagaaatgtgatacccttctgtgcgacatcggcgagtctagcccgaatcccacaatcgaagaggggagaacgctgcgcgtgctcaagatggttgaaccttggctgcggggaaaccaattctgtattaagatccttaatccctatatgccttccgtggtcgagaccctggagcagatgcagagaaaacacggcggcatgctcgtgcgcaaccccctgagcagaaattctacacatgaaatgtactgggtttcctgcgggaccggaaacatcgtgagcgcggtcaatatgacatctagaatgctgctcaaccgctttaccatggcccaccggaagccgacgtatgagagagatgtggacctgggcaccgggacacgccacgtggctgtcgaacctgaggttgccaaccttgatattatcggacagagaattgaaaatatcaaacatgagcacaagtccacctggcattacgacgaggataacccctataaaacatgggcttaccacggcagctatgaagtgaagccctctgggtccgccagctccatggtgaatggagtcgtgaagctgctcaccaaaccttgggacgttattcccatggtgacacaaatcgctatgaccgatacgacacctttcggccagcagcgggtctttaaggagaaagtggacacccgcaccccgaaggccaaaagaggcacagcgcaaatcatggaagttacggcccggtggctgtgggggttccttagcagaaacaagaagccccggatttgtacccgcgaggaatttacaagaaaagtgcggtctaatgctgccatcggagctgtcttcgtggacgagaaccagtggaatagcgccaaggaggccgttgaagatgagcgcttttgggacctggtgcatagagaacgggagctccacaaacagggcaagtgcgcgacctgcgtctacaacatgatggggaaacgcgaaaagaagctgggagagttcggcaaagctaaggggtccagagccatttggtacatgtggctgggcgcccggtttctcgagttcgaagctctgggattcatgaatgaggatcactggttttctcgcgaaaacagcctttccggcgtggagggggagggactgcataaactcggctatatcctgagagacatttctaagatccctgggggaaatatgtacgccgatgacacagctggctgggatacccggatcacagaagacgatcttcagaacgaggccaaaattaccgacatcatggaacccgagcacgcgctgctcgccaaggctattttcaaactgacgtatcaaaataaggtcgtgcgcgttcagagacctgccaagaacgggaccgtgatggatgtcatcagccggcgcgaccagagaggctccggacaggtgggcacatacgggctgaatacctttacaaacatggaagctcaactcattcggcagatggagtctgagggaatcttcagcccctccgaactggagaccccgaaccttgccgaaagagcgctggattggctcgagaaatatggcgtggaacgcctgaagcggatggccatcagcggggacgactgtgttgtgaaacctattgatgacagatttgctacggcccttacagctctgaatgatatgggaaaggtccgcaaagacatcccccagtgggagccttctaagggctggaacgattggcagcaagtgcccttctgctcccatcactttcaccagctcattatgaaggacgggcgggagatcgttgtgccttgtagaaatcaggatgaactggtcggccgcgcccgggtgagccagggagctggctggtctctgagagagaccgcctgcctcgggaaatcctacgcgcaaatgtggcagctgatgtatttccatcgccgggaccttagactggccgctaacgccatttgtagcgccgtccccgtggattgggttccgacatcccgcaccacgtggtctatccacgctcatcaccagtggatgaccacagaagacatgctcagcgtgtggaatcgggtctggattgaggaaaacccttggatggaggataagacccatatctccagctgggaggacgtgccctacctgggaaaaagagaagaccaatggtgcggctctcttatcgggctgacagcccgggcgacctgggctacaaatattcaggttgccatcaaccaggtgagacgcctcattggaaatgagaactacctggattatatgacctccatgaagcggtttaaaaatgaaagcgaccccgagggcgccctgtggtga

SEQ ID NO: 18544 - RNA, 9882 nt, synthetic construct
  misc_feature 1..9882: note = derived and/or modified CDS sequence (opt5) from DENV-1__FJ639670__SS-prME
  source 1..9882: mol_type = other RNA
agcgtgaccatgctgctcatgctgatgcccaccgcccttgctttccacctgacgaccagaggaggggagcctcatatgatcgtgtccaagcaggaacggggaaaatctctcctgtttaagaccagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcaccggcgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggcccaggggaaaaagatgatccggccgcaacccatggagtacaaatattcttggaaaagctggggaaaggccaagattatcggcgctgacgcgcagaataccaccttcatcattgatgggcctaacacacccgaatgtcctgacgatcagagagcctggaatatctgggaggtggaggactacggatttggcattttcaccacgaacatctggctgaaacttcgcgattcctatacacaggtctgcgaccaccggctcatgagcgctgccattaaagattctaaggccgttcacgctgacatgggctactggatcgaatccgagaaaaatgaaacctggaagctggccagagcgagctttatcgaggtgaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggatttcgacctctgcgaagggacgaccgtcgtggttgatgagcactgcggaaaccggggccccagcctgagaacaaccacagtgaccggcaagatcatccacgaatggtgttgccggtcctgtacgctgcctccccttcgctttagaggggaggacggatgctggtatggcatggagattcggccggtcaaagaaaaggaggaaaatctcgtcaagagcatggtttctgccgggtccggagaggtggacagcttctccctgggcctgctctgtatctctattatgatcgaagaggtcatgagaagccgctggtcccggaaaatgctgatgacagggacccttgccgtgtttttcctgctcattatgggacagctgacatggaacgatctgatcagactttgcattatggttggcgctaatgcctctgaccgcatgggcatggggaccacctacctggcgctcatggctacatttaagatgagacctatgttcgccgtgggactgctctttcggcgcctgacgagcagagaggtccttctgctcaccatcggcctgtccctggtggcctctgtggaacttcccaacagcctggaggaactcggggatggactggctatgggcatcatgattctcaaactgcttacagacttccaatcccatcagctgtgggccaccctcctgagcctgacatttatcaagaccacgttctctcttcactatgcttggaaaacaatggccatggtcctgtccattgttagcctctttcccctgtgtctctctaccacctcccagaagacaacctggctgcctgtgcttctggggagcctgggatgcaagccgctcacaatgttcctgatcgcggagaataaaatttggggccggaagtcttggccccttaacgaaggcatcatggccgtggggatcgtctccattctgctcagctccctgctcaaaaacgatgtgcctctggctggaccccttatcgccggcgggatgctgattgcttgttacgttatcagcggatctagcgccgacctgtccctcgagaaggccgctgaggtgtcttgggaagaggaagcggagcatagcggcgcctcccacaatattctggtcgaagtgcaggatgacgggacgatgaaaatcaaggatgaggagcgcgacgatacccttacaatcctgctcaaagctaccctgctcgccgtttctggagtgtatcctctgagcattcccgccacactttttgtctggtacttctggcaaaagaagaaacagagatccggcgtgctgtgggacaccccttctcccccggaagtcgagcgggctgtgctggatgacggcatctatcgcattatgcagagagggctcctgggacggagccaggttggcgtgggggtcttccaagaaaacgtgtttcatacgatgtggcacgttacccgcggagccgtgcttatgtaccagggcaagagactggagccttcctgggcgagcgtcaaaaaggacctcatctcttacgggggaggctggcggctgcagggctcctggaatacaggggaggaagtccaggtgattgctgttgagcccggcaagaaccctaagaatgtccaaaccgcccccggcacattcaagaccccggaaggggaggtgggagccatcgctctcgattttaaacctggcacaagcgggtctcccattgtgaacagagaaggaaagatcgtcggcctgtatggcaatggggtggttacgacctccggaacatacgtgagcgccatcgcgcaggctaaagcctcccaggagggccctcttcccgagattgaagacgaggtcttccgcaagcggaacctgaccatcatggatctgcaccccgggtctggaaaaaccagacgctatctccctgccattgtgcgggaagctatcaagagaaagctgcgcacacttattctggccccgacgcgggttgtggctagcgagatggccgaagcgctcaaaggcatgcccatcagataccaaaccacagccgtcaagtccgagcataccgggaaagagatcgtggacctgatgtgccacgctacatttaccatgcgcctgctcagccctgttcgggtgcccaattataacatgattatcatggatgaagcccatttcacggacccttcttccattgctgccagaggctacatcagcacacgggtcggaatgggcgaggccgctgcgatttttatgaccgccacaccccctgggtctgtggaggctttcccgcagagcaatgccgtgatccaggatgaggaacgcgacatccccgagagatcctggaactctggatatgagtggattacagattttcctggcaagaccgtctggttcgttcccagcatcaaatccgggaatgacattgccaactgtcttcggaagaatggaaagcgcgtgatccagctgtctagaaaaacatttgataccgaataccaaaagacgaaaaacaacgactgggactacgtggtcacaaccgatattagcgagatgggcgctaatttccgggccgacagagtgatcgatcctcgccggtgcctgaagcccgttattctcaaagacgggccggaaagagtgatcctggcgggccctatgcccgtcacagtggcttccgccgcccagcgccggggaagaatcggccgcaaccacaataaggagggggatcagtatatttacatgggacagccccttaacaatgacgaggatcatgctcactggaccgaagccaagatgctgctcgacaacatcaatacgcctgagggcattatccccgcgctgttcgaacctgagcgggaaaagagcgccgctattgatggggagtatagactgcgcggagaggccagaaagacctttgttgagctcatgcggcgcggcgaccttccggtgtggctgtcttacaaagtcgcttccgaggggttccaatatagcgatagacggtggtgctttgacggcgaacgcaacaatcaggtgctggaggaaaacatggatgtcgagatctggacaaaggagggagtgtcccgcaaaaatctccggcccagatggctggacgcccgcacctactctgaccctcttgctctgcgggagttcaaggagtttgccgcgggcagacgcagcgtttccggggatctcatcctggaaattggaaaactgccccagcacctcacacagcgggcccaaaacgctcttgacaatctggtgatgctgcataactctgagcagggcgggagagcctatcggcacgctatggaagaactccctgataccatcgagacactgatgcttctggccctcattgccgtgctgaccggaggcgtcacgctgttctttctcagcggccgcgggcttggaaagacatccatcggcctgctgtgtgttatggctagctctgtgctcctgtggattgcgtccgtggaaccccattggatcgccgctagcatcattcttgagttctttctgatggtcctcctgatcccggaacctgacagacagcggacaccccaggataatcaactggcctacgtggttattgggctccttttcatgatcctgaccgtggccgctaacgagatgggactgctcgagacaaccaagaaagacctgggcattgggcacgtcgccgtggaaaaccaccatcacgcggccatgcttgatgtcgacctgcatcctgcttctgcctggacactctacgctgtggccacgaccatcattacacccatgatgcgccacaccatcgagaatacaaccgcgaacatctccctgacggccattgctaatcaggccgctatcctgatgggactcgataagggctggcctattagcaaaatggacatcggcgttccccttctggccctggggtgctattctcaggtgaacccgctcaccctgacagctgccgtccttatgctggtggcgcattacgccattatcggacctggcctccaagctaaggccaccagagaagctcagaaacggacagccgccgggatcatgaagaatcccaccgttgatggaattgtggcgatcgacctggatcccgtcgtgtatgacgctaagtttgagaaacagctgggccagattatgctccttatcctgtgtacgagccaaattctgctcatgcgcacaacctgggccctgtgcgaatccatcacacttgctaccgggcctctgaccacactctgggagggatctccgggcaagttctggaacacgaccatcgccgtgagcatggccaatatttttagaggctcctacctggctggggccggactggcgttcagcctcatgaaatcccttggcgggggacggcgcggcacaggggcccagggagagaccctgggcgaaaagtggaaaagacagctgaaccagctctctaagagcgagttcaatacatataagcggtccggcatcatggaagttgacagatctgaggctaaagaagggctgaagcgcggagagaccacgaaacacgccgtcagccggggcacagctaaacttagatggtttgtggagcgcaacctggtgaaacccgaagggaaggtcattgatctcggatgtggcagagggggatggtcctactattgcgccggcctgaagaaagttaccgaggtgaagggctacaccaaagggggacctggccacgaagaacccatccctatggcgacatacgggtggaatctggtgaagctccattctggaaaagacgtcttctttattccccctgaaaagtgtgatacccttctgtgcgacatcggcgagagctccagcaacccgacaattgaggaagggagaacgctgcgcgtgctcaaaatggttgagccctggctgcggggaaatcaattctgtatcaagatccttaacccttatatgccctctgtggtcgaaaccctggagcagatgcagagaaagcacggcggcatgctcgtgcgcaatcctctgtcccggaacagcacacatgagatgtactgggtttcttgcgggaccggaaatattgtgtccgccgtcaacatgacaagcagaatgctgctcaaccgctttaccatggctcaccggaaacccacgtatgaaagagatgtggacctgggcaccgggacacgccacgtggccgtcgagccggaagttgctaatcttgatatcattggacagagaatcgagaacattaagcatgaacacaaatctacctggcattacgacgaggataatccttataagacatgggcctaccacggctcctatgaggtgaaacccagcgggtccgctagctctatggtgaacggagtcgtgaagctgctcaccaagccctgggacgttatccctatggtgacacaaatcgccatgaccgatacgacacccttcggccagcagcgggtctttaaagaaaaggtggacacccgcacccctaaagcgaagagaggcacagcccaaattatggaggttacggctcggtggctgtgggggttccttagcagaaataaaaagccgcggatctgtacccgcgaagagtttacaagaaaggtgcggtccaacgccgctattggagccgtcttcgtggacgaaaatcagtggaactctgccaaagaggcggttgaggatgaacgcttttgggacctggtgcatagagagcgggaactccacaagcagggcaaatgcgctacctgcgtctacaatatgatggggaagcgcgagaaaaagctgggagagttcggcaaggccaaagggagcagagccatctggtacatgtggctgggcgctcggtttctcgagttcgaggccctgggattcatgaacgaagatcactggttttcccgcgaaaattctcttagcggcgtggaaggggagggactgcataagctcggctatattctgagagacatctccaaaatccccgggggaaacatgtacgctgatgacacagccggctgggatacccggattacagaggacgatcttcagaatgaagcgaagatcaccgacattatggagcctgaacacgccctgctcgctaaagccatcttcaagctgacgtatcaaaacaaagtcgtgcgcgttcagagacccgctaagaatgggaccgtgatggatgtcatttctcggcgcgaccagagaggcagcggacaggtgggcacatacgggctgaacacctttacaaacatggaggcccaactcatccggcagatggaatccgagggaatcttcagcccttctgagctggaaacccccaatcttgcggagagagccctggattggctcgaaaagtatggcgtggagcgcctgaaacggatggctatttccggggacgactgtgttgtgaagccgatcgatgacagatttgccacggctcttacagccctgaacgatatgggaaaagtccgcaaggacattcctcagtgggaacccagcaaaggctggaatgattggcagcaagtgcctttctgctctcatcactttcaccagctcatcatgaaggacgggcgggagattgttgtgccctgtagaaaccaggatgagctggtcggccgcgctcgggtgtcccagggagccggctggagcctgagagaaaccgcgtgcctcgggaagtcctacgcccaaatgtggcagctgatgtatttccatcgccgggaccttagactggctgccaatgccatctgttctgctgtccctgtggattgggttcccacaagccgcaccacgtggtccattcacgcccatcaccagtggatgaccacagaggacatgctcagcgtgtggaaccgggtctggatcgaagagaatccgtggatggaagataaaacccatatctcttcctgggaggacgtgccttacctgggaaagagagaggaccaatggtgcggcagccttattgggctgacagcgcgggctacctgggccacaaacatccaggttgccattaatcaggtgagacgcctcatcggaaacgaaaattacctggattatatgacctctatgaaacggtttaagaacgagagcgaccccgaaggcgctctgtggtga

SEQ ID NO: 18545 - RNA, 9879 nt, synthetic construct
  misc_feature 1..9879: note = derived and/or modified CDS sequence (opt5) from DENV-1__FJ639671__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacactgacctacaaatgcccgcgcatcacagaggtggaacccgacgatgtggactgttggtgcaataccacggatacctgggtcacatatggaacctgttcccaaacaggcgagcacagacgggacaagcgctctgtggctctggcccctcatgttgggctcggactggagaccagagccgaaacgtggatgagctccgagggcgcttggaaacagattcagcgggtggaaacatgggcccttcgccaccccggcttcaccgtcatcgctctgtttctcgcccatgcgattgggacatctatcacccagaagggaatcattttcatcctgcttatgctggtgacccctagcatggccatgagatgcgttggcattgggtcccgggattttgtggagggactcagcggcgctacatgggtcgacgtggtgctggagcacgggtcttgtgtcacgaccatggccaaggataaacccacactggacatcgaactcctgaagaccgaggttacaaaccctgctgtgcttcgcaaactgtgcattgaagccaagatctccaataccacgacagatagcagatgtccgacccaaggagaggcgaccctcgtggaagagcaggacgccaacttcgtctgccggcgcacatttgtggatagaggctggggcaatgggtgtggactgttcggcaaagggtctcttattacctgcgctaagtttaagtgcgttacaaaactggagggaaagatcgtgcagtacgaaaacctcaaatattccgtcatcgtgacggttcacaccggcgaccagcatcaagtggggaatgagagcacagaacacggaaccacagccaccattacgccccaggctcctacctctgagatccagctgacagactacggcgccctgaccctcgattgttccccccggacaggcctggacttcaacgaaatggtccttctgaccatgaaggagaaaagctggctcgtgcataagcagtggtttctggatcttcctctgccctggacgtccggggcctctacaagccaagagacctggaatcgccaggacctcctggtcacattcaaaaccgctcacgcgaagaagcaggaagtggttgtgctgggatcccaagagggcgccatgcacaccgctctcacaggggccacggaaattcagaccagcggaacaaccacaatctttgccggccatctgaaatgcagacttaagatggataaactgaccctcaaggggatgtcttatgtcatgtgtacgggctccttcaaactggagaaggaagtggctgagacacagcacggaaccgttctggtgcagattaagtacgagggcaccgacgccccgtgcaaaatccctttcagcacacaagatgggaagggagtcacccagaacggccggcttatcacagcgaatcccattgtgacggacaaagaaaagcctgtgaacatcgaggctgaacccccctttggggagtcttatattgttatcggagccggcgagaaagccctcaagctgagctggttcaagaaagggtcctctattggcaagatgtttgaagctaccgccagaggagctcgccggatggccatcctgggcgatacagcgtgggacttcgggagcgtcggaggcgtgtttacctccgtggggaaactcgtccatcagatcttcggaacagcctacggcgtgctgtttagcggggtttcttggaccatgaagattggcatcggagtgcttctgacgtggctcggcctgaattccagaagcacctctctgtccatgacatgtattgctgtcgggcttgtgaccctctacctgggagttatggtgcaggccgatagcggctgcgtcatcaactggaaagggcgcgagctgaagtgtggatccggcattttcgtgacaaatgaagttcacacctggacagagcaatataagtttcaggctgactctcctaaacggctcagcgccgcgatcgggaaggcctgggaagagggcgtgtgcggaattagatccgctacccgcctggagaacgtcatgtggcggcagatctctaacgaacttaatcatatcctgctcgagaacgacatgaaattcacggtggtggtcggcgatgttgtggggattctggcccagggaaagaaaatgatcagaccgcaacccatggaacacaagtacagctggaaatcctggggcaaggctaagattatcggggccgacgtgcagaatacaacctttattatcgatggacctaacaccagcgagtgtcccgacgatcagcgcgcctggaatatctgggaagtcgaggactatggcttcggcatttttacaaccaacatctggctgaaacttcgggattcttacacgcaggtgtgcgaccacagactcatgtccgctgcgattaaggatagccgcgccgttcatgctgacatggggtattggatcgagtctgaaaaaaatgagacatggaagctggcccgggcctccttcattgaagtgaaaacctgtatctggcctaagagccacacactgtggtctaacggagtcctcgagagcgaaatgatcattcccaagatctacggcgggccgatttcccaacataattatagacctggatacttcacccagacagctggcccctggcacctggggaaacttgagctggattttgacctctgcgagggaaccacggtggttgtggatgaacactgcggcaaccggggccctagcctgcgcaccacaaccgtcacagggaagatcattcatgagtggtgttgcagatcttgtaccctgccccctcttcggttcaaaggagaagacggctgctggtacgggatggagatcagacccgtgaaggagaaagaagagaatctcgttaagtccatggtgagcgccggatccggcgaagtcgactcttttagcctggggctgctctgtatctccattatgatcgaggaagtgatgcgctctcggtggagcagaaagatgctgatgacgggaacacttgcggtgttctttctgctcattatgggccagctgacctggaacgatctgatccgcctttgcattatggtcggcgctaatgcctccgacagaatggggatgggaacaacctatctggccctcatggctaccttcaaaatgcggccgatgtttgccgttggcctgctcttccgcagactgacatctcgggaggtgcttctgctcacgatcgggctgagcctggtggcgtccgtcgagcttcctaacagcctggaagagctcggagatggcctggctatggggattatgatcctcaagctgcttaccgactttcaatcttaccagctgtgggccacactcctgtccctgaccttcatcaaaacaacctttagccttcactatgcctggaagacgatggctatggtgctgtctattgtttccctcctgcccctctgtctgagcacaacctctcagaaaaccacatggcttcccgtgctgctgggatccctcggctgcaagcctctgaccatgttccttatcgccgaaaataagatttggggccgcaaaagctggccgctgaacgaggggatcatggctgtcggaattgtgtccatcctcctgagctctctcctgaagaacgatgttccccttgccggccctctgatcgcggggggaatgctgattgcctgttacgtgatcagcggctcctctgctgacctcagcctggaaaaagccgctgaggtctcctgggaggaagaggccgaacattctggggccagccacaatattcttgtggaggtccaggatgacggaacaatgaagatcaaagatgaagagagagacgatacgctgaccattctcctgaaggctacactcctggcggtgtccggcgtttatcccctttctatccctgccaccctgtttgtgtggtacttctggcaaaaaaagaagcagcggagcggcgtcctgtgggacacaccctcccctcccgaggtggaacgcgctgttctcgatgacgggatctatagaattatgcagcggggactgcttggccgcagccaggtgggggtcggagtgttccaagagaacgtgtttcataccatgtggcacgttacgagaggcgccgtcctgatgtaccaggggaaacggctcgaaccgtcttgggcctccgtgaagaaagacctgatcagctacggaggcggctggagactccaggggtcttggaataccggagaggaggtgcaggtcattgctgtggaacctggcaagaaccccaaaaatgttcaaacagcccctgggaccttcaagacacccgagggagaagtgggcgcgatcgctctggattttaagccggggacctccggaagccctattgtcaaccgcgagggcaaaatcgtgggcctttatgggaatggagttgtgacaacgtccggcacctacgtctctgccattgcccaggctaaggccagccaggaagggcccctgcctgagatcgaggacgaagtgttccggaaaagaaacctgacaatcatggatctccaccccggatccggcaagacccgccggtatctgcccgcgattgttagagaggctatcaaacgcaagcttcggaccctgattctcgcccctacaagagtggtcgccagcgaaatggctgaggccctgaaggggatgccgatccgctaccaaacgaccgctgtgaaatctgaacatacaggccgggagattgtggacctgatgtgccacgccacctttacaatgagactcctttcccccgtccgggttcctaattataacatgatcatcatggatgaggcgcatttcaccgaccccagctctattgccgctcgcggatacatcagcacgagagtgggcatgggggaagccgctgccatttttatgacagccacccctcccggatccgtggaggctttccctcagtctaatgcggtcatccaggatgaagagcgggacattccggaacgcagctggaactccggctatgagtggatcaccgattttcccgggaagacagtgtggttcgttccttctatcaaaagcggaaatgacattgccaactgtctgagaaagaatggcaaacgggtgatccagctgtccagaaagacctttgatacagagtaccaaaagaccaaaaacaacgactgggactacgtcgtgacgacagatattagcgaaatgggggctaatttccgcgccgaccgggttatcgatcccagacgctgcctcaagcctgtgattctgaaagacggccccgagcgggtcatccttgccggaccgatgcctgtgaccgtcgcttctgccgcgcagagacgcggccggattgggagaaaccacaataaggaaggagatcagtatatctacatgggccagcccctgaacaatgacgaggatcatgctcactggacagaggccaaaatgctcctggacaacatcaatacccccgaagggattatccctgccctgttcgagcccgaacgcgagaagtccgctgccattgatggagaatatagactccggggcgaggcgcgcaagacgtttgtggagcttatgagacggggggacctgcctgtttggctgagctacaaagtggcctccgaaggcttccaatattctgatcgcagatggtgctttgacggagagcggaacaatcaggtgctcgaagagaacatggatgtcgaaatctggaccaaggagggcgagagaaaaaagctgcgcccgcggtggcttgacgctagaacatacagcgaccccctggccctccgcgaattcaaagagtttgctgccgggcggagatccgtttctggagatctgattctggaaatcggcaagctccctcagcaccttacccagcgggctcaaaatgccctggacaacctggtgatgctccataatagcgagcaggggggacgcgcgtatagacacgccatggaagagctgcccgagacaatcgaaacccttatgctgctcgctctgattgccgtgctgacaggcggcgtcaccctcttctttctttccgggcggggactgggcaaaacgagcatcgggctgctctgtgtgatggcttcttccgccctgctttggatggccagcgttgagcctcattggattgctgcgtctatcattctggaattctttctcatggtgctgctgatccccgagccggatcgccagagaacacctcaggacaaccaactcgcctacgtcgtgatcggacttctgttcatgattctgaccgtcgctgccaatgagatgggcctcctggaaaccacaaagaaggatcttgggatcggacacgtggccgttgagaaccaccatcacgctaccatgctggacgtggatctccatcccgcctccgcgtggacactgtacgccgtcgctacgaccattatcacacctatgatgcggcacaccattgaaaacacaaccgccaatatcagcctgacggctattgccaaccaggcggccatcctcatgggccttgacaaaggctggcccatctctaagatggatattggggtgcctctgctggctctcggatgctatagccaggttaatcccctgacccttacagccgctgtgctgatgctcgtcgcccattacgctatcattggcccggggctgcaagccaaagcgacccgcgaggcccagaagagaacagctgccggaatcatgaaaaaccctaccgtggacggcattgtggctatcgatctggaccccgttgtctatgatgccaagtttgaaaagcagctcgggcagatcatgcttctgattctgtgtacgtcccaaatcctcctgatgcggacaacctgggccctttgcgagtctattacactggcgaccggacccctcaccacactgtgggagggcagccctggcaaattctggaatacgaccatcgctgtgtccatggccaacatttttcgcgggagctacctggctggagccggcctcgccttctcccttatgaagtctctggggggaggcagacgggggacaggagctcagggcgaaaccctgggcgagaaatggaagagacagctcaatcagctgagcaaatccgaattcaacacatataagcgctctgggatcatggaggtggaccggagcgaagccaaggagggacttagacgcggcgagaccacgaaacacgcggtctcccgggggacagccaagctgagatggtttgttgaacgcaatctcgtgaaaccggagggaaaggtgatcgacctgggctgtgggcggggaggctggtcttactattgcgctggcctgaaaaaggtcaccgaagtgaaggggtacaccaaaggaggccccgggcacgaggaacctattcccatggccacatacggatggaacctcgttaagcttcatagcggcaaagatgtgttctttatccctcccgagaagtgtgacaccctgctgtgcgatattggggagtccagccctaatccgacaatcgaagagggaagaacgctccgcgtcctgaaaatggtggaaccctggcttcggggcaaccaattctgtattaagatcctgaatccttatatgccctctgttgtggagaccctcgagcagatgcagagaaaacacggcgggatgctggtccgcaaccctctgtcccggaatagcacacatgaaatgtactgggtgtcttgcggaaccggcaacattgtgtccgctgtcaatatgacaagcagaatgctcctgaaccgctttaccatggcccacagaaagcccacgtatgagcgggacgttgatcttggggcgggaacccgccacgtggccgtggaaccggaggtcgctaacctggacatcatcggccagagaattgaaaatatcaagcatgagcacaaatctacatggcattacgatgaggacaacccttataagacctgggcctaccacgggtcctatgaagtgaaacccagcggatccgctagctctatggttaatggcgtggtcaagctcctgacaaaaccctgggatgtgattcctatggttacccaaatcgccatgacagacaccacgcccttcggccagcagcgggtgtttaaggagaaggtcgatacaagaacccctaaagctaagcgggggaccgcccaaattatggaagtgacagcgcgctggctttggggattcctgagcagaaacaaaaagccgcggatctgtacgcgcgaggaatttaccagaaaagttcggtccaatgccgctatcggcgccgtgttcgtcgacgagaaccagtggaattctgctaaggaggccgtggaagacgagcgcttttgggatctcgtccatagagaacgggagctgcacaagcaggggaaatgcgccacatgcgtgtacaacatgatgggaaagcgcgaaaaaaagctgggcgagttcgggaaagcgaagggcagcagagctatttggtacatgtggctcggagcccggtttctggagttcgaagcccttggcttcatgaatgaggaccactggttttcccgcgaaaactctctgagcggggttgagggagagggcctccataagctggggtatatccttagagatatttccaaaatccccggaggcaatatgtacgctgacgataccgccgggtgggacacacggattaccgaagatgacctgcagaacgaggctaagatcacagatatcatggaacctgagcacgccctcctggcgacctctattttcaaactgacgtatcaaaataaggtggtccgcgtgcagagacccgccaaaaacggcaccgtgatggacgttatcagccggagagatcagcgcggatccggccaggtggggacatacggactcaatacctttacaaacatggaagctcaactgattcggcagatggagagcgagggcatcttctctccttccgaacttgagacccccaacctggccgaaagagtcctcgactggctggagaagtatggggtggaacgccttaaacggatggctattagcggagatgactgtgttgtgaagccgatcgacgatagatttgccacggcgctgacagccctcaatgacatgggcaaggtccgcaaagatatccctcagtgggagccctctaaggggtggaacgactggcagcaagtgcctttctgctcccatcactttcaccagctgattatgaaagatggccgggagatcgtcgtgccctgtagaaatcaggacgaactggttggacgcgctcgggtgagccagggcgccgggtggtccctcagagagaccgcttgcctgggaaagtcttacgcccaaatgtggcagcttatgtatttccatcgccgggatctgagactcgctgccaacgcgatttgtagcgccgtccctgtggactgggttcccacatcccggaccacgtggagcatccacgctcatcaccagtggatgaccacagaagatatgctgtctgtgtggaatagagtctggattgaggaaaacccgtggatggaggacaaaacccatatctccagctggggcgatgtgccttaccttgggaagcgcgaggaccaatggtgcggatctctgattggcctcacagcccgggccacctgggctacaaatatccaggtggccatcaaccaggttagacgcctgattgggaatgaaaactacctggactatatgaccagcatgaagagatttaaaaatgagtccgatcccgaaggcgcgctctggtga

SEQ ID NO: 18546 - RNA, 9879 nt, synthetic construct
  misc_feature 1..9879: note = derived and/or modified CDS sequence (opt5) from DENV-1__JN819423__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacactgacctacaaatgcccgcgcatcacagaggtggaacccgacgatgtggactgttggtgcaataccacggatacctgggtcacatatggaacctgttcccaaacaggcgagcacagacgggacaagcgctctgtggctctggcccctcatgttgggctcggactggagaccagagccgaaacgtggatgagctccgagggcgcttggaaacagattcagcgggtggaaacatgggcccttcgccaccccggcttcaccgtcatcgctctgtttctcgcccatgcgattgggacatctatcacccagaagggaatcattttcatcctgcttatgctggtgacccctagcatggccatgagatgcgttggcattgggtcccgggattttgtggagggactcagcggcgctacatgggtcgacgtggtgctggagcacgggtcttgtgtcacgaccatggccaaggataaacccacactggacatcgaactcctgaagaccgaggttacaaaccctgctgtgcttcgcaaactgtgcattgaagccaagatctccaataccacgacagatagcagatgtccgacccaaggagaggcgaccctcgtggaagagcaggacgccaacttcgtctgccggcgcacatttgtggatagaggctggggcaatgggtgtggactgttcggcaaagggtctcttattacctgcgctaagtttaagtgcgttacaaaactggagggaaagatcgtgcagtacgaaaacctcaaatattccgtcatcgtgacggttcacaccggcgaccagcatcaagtggggaatgagagcacagaacacggaaccacagccaccattacgccccaggctcctacctctgagatccagctgacagactacggcgccctgaccctcgattgttccccccggacaggcctggacttcaacgaaatggtccttctgaccatgaaggagaaaagctggctcgtgcataagcagtggtttctggatcttcctctgccctggacgtccggggcctctacaagccaagagacctggaatcgccaggacctcctggtcacattcaaaaccgctcacgcgaagaagcaggaagtggttgtgctgggatcccaagagggcgccatgcacaccgctctcacaggggccacggaaattcagaccagcggaacaaccacaatctttgccggccatctgaaatgcagacttaagatggataaactgaccctcaaggggatgtcttatgtcatgtgtacgggctccttcaaactggagaaggaagtggctgagacacagcacggaaccgttctggtgcagattaagtacgagggcaccgacgccccgtgcaaaatccctttcagcacacaagatgggaagggagtcacccagaacggccggcttatcacagcgaatcccattgtgacggacaaagaaaagcctgtgaacatcgaggctgaacccccctttggggagtcttatattgttatcggagccggcgagaaagccctcaagctgagctggttcaagaaagggtcctctattggcaagatgtttgaagctaccgccagaggagctcgccggatggccatcctgggcgatacagcgtgggacttcgggagcgtcggaggcgtgtttacctccgtggggaaactcgtccatcagatcttcggaacagcctacggcgtgctgtttagcggggtttcttggaccatgaagattggcatcggagtgcttctgacgtggctcggcctgaattccagaagcacctctctgtccatgacatgtattgctgtcgggcttgtgaccctctacctgggagttatggtgcaggccgatagcggctgcgtcatcaactggaaagggcgcgagctgaagtgtggatccggcattttcgtgacaaatgaagttcacacctggacagagcaatataagtttcaggctgactctcctaaacggctcagcgccgcgatcgggaaggcctgggaagagggcgtgtgcggaattagatccgctacccgcctggagaacgtcatgtggcggcagatctctaacgaacttaatcatatcctgctcgagaacgacatgaaattcacggtggtggtcggcgatgttgtggggattctggcccagggaaagaaaatgatcagaccgcaacccatggaacacaagtacagctggaaatcctggggcaaggctaagattatcggggccgacgtgcagaatacaacctttattatcgatggacctaacaccagcgagtgtcccgacgatcagcgcgcctggaatatctgggaagtcgaggactatggcttcggcatttttacaaccaacatctggctgaaacttcgggattcttacacgcaggtgtgcgaccacagactcatgtccgctgcgattaaggatagccgcgccgttcatgctgacatggggtattggatcgagtctgaaaaaaatgagacatggaagctggcccgggcctccttcattgaagtgaaaacctgtatctggcctaagagccacacactgtggtctaacggagtcctcgagagcgaaatgatcattcccaagatctacggcgggccgatttcccaacataattatagacctggatacttcacccagacagctggcccctggcacctggggaaacttgagctggattttgacctctgcgagggaaccacggtggttgtggatgaacactgcggcaaccggggccctagcctgcgcaccacaaccgtcacagggaagatcattcatgagtggtgttgcagatcttgtaccctgccccctcttcggttcaaaggagaagacggctgctggtacgggatggagatcagacccgtgaaggagaaagaagagaatctcgttaagtccatggtgagcgccggatccggcgaagtcgactcttttagcctggggctgctctgtatctccattatgatcgaggaagtgatgcgctctcggtggagcagaaagatgctgatgacgggaacacttgcggtgttctttctgctcattatgggccagctgacctggaacgatctgatccgcctttgcattatggtcggcgctaatgcctccgacagaatggggatgggaacaacctatctggccctcatggctaccttcaaaatgcggccgatgtttgccgttggcctgctcttccgcagactgacatctcgggaggtgcttctgctcacgatcgggctgagcctggtggcgtccgtcgagcttcctaacagcctggaagagctcggagatggcctggctatggggattatgatcctcaagctgcttaccgactttcaatcttaccagctgtgggccacactcctgtccctgaccttcatcaaaacaacctttagccttcactatgcctggaagacgatggctatggtgctgtctattgtttccctcctgcccctctgtctgagcacaacctctcagaaaaccacatggcttcccgtgctgctgggatccctcggctgcaagcctctgaccatgttccttatcgccgaaaataagatttggggccgcaaaagctggccgctgaacgaggggatcatggctgtcggaattgtgtccatcctcctgagctctctcctgaagaacgatgttccccttgccggccctctgatcgcggggggaatgctgattgcctgttacgtgatcagcggctcctctgctgacctcagcctggaaaaagccgctgaggtctcctgggaggaagaggccgaacattctggggccagccacaatattcttgtggaggtccaggatgacggaacaatgaagatcaaagatgaagagagagacgatacgctgaccattctcctgaaggctacactcctggcggtgtccggcgtttatcccctttctatccctgccaccctgtttgtgtggtacttctggcaaaaaaagaagcagcggagcggcgtcctgtgggacacaccctcccctcccgaggtggaacgcgctgttctcgatgacgggatctatagaattatgcagcggggactgcttggccgcagccaggtgggggtcggagtgttccaagagaacgtgtttcataccatgtggcacgttacgagaggcgccgtcctgatgtaccaggggaaacggctcgaaccgtcttgggcctccgtgaagaaagacctgatcagctacggaggcggctggagactccaggggtcttggaataccggagaggaggtgcaggtcattgctgtggaacctggcaagaaccccaaaaatgttcaaacagcccctgggaccttcaagacacccgagggagaagtgggcgcgatcgctctggattttaagccggggacctccggaagccctattgtcaaccgcgagggcaaaatcgtgggcctttatgggaatggagttgtgacaacgtccggcacctacgtctctgccattgcccaggctaaggccagccaggaagggcccctgcctgagatcgaggacgaagtgttccggaaaagaaacctgacaatcatggatctccaccccggatccggcaagacccgccggtatctgcccgcgattgttagagaggctatcaaacgcaagcttcggaccctgattctcgcccctacaagagtggtcgccagcgaaatggctgaggccctgaaggggatgccgatccgctaccaaacgaccgctgtgaaatctgaacatacaggccgggagattgtggacctgatgtgccacgccacctttacaatgagactcctttcccccgtccgggttcctaattataacatgatcatcatggatgaggcgcatttcaccgaccccagctctattgccgctcgcggatacatcagcacgagagtgggcatgggggaagccgctgccatttttatgacagccacccctcccggatccgtggaggctttccctcagtctaatgcggtcatccaggatgaagagcgggacattccggaacgcagctggaactccggctatgagtggatcaccgattttcccgggaagacagtgtggttcgttccttctatcaaaagcggaaatgacattgccaactgtctgagaaagaatggcaaacgggtgatccagctgtccagaaagacctttgatacagagtaccaaaagaccaaaaacaacgactgggactacgtcgtgacgacagatattagcgaaatgggggctaatttccgcgccgaccgggttatcgatcccagacgctgcctcaagcctgtgattctgaaagacggccccgagcgggtcatccttgccggaccgatgcctgtgaccgtcgcttctgccgcgcagagacgcggccggattgggagaaaccacaataaggaaggagatcagtatatctacatgggccagcccctgaacaatgacgaggatcatgctcactggacagaggccaaaatgctcctggacaacatcaatacccccgaagggattatccctgccctgttcgagcccgaacgcgagaagtccgctgccattgatggagaatatagactccggggcgaggcgcgcaagacgtttgtggagcttatgagacggggggacctgcctgtttggctgagctacaaagtggcctccgaaggcttccaatattctgatcgcagatggtgctttgacggagagcggaacaatcaggtgctcgaagagaacatggatgtcgaaatctggaccaaggagggcgagagaaaaaagctgcgcccgcggtggcttgacgctagaacatacagcgaccccctggccctccgcgaattcaaagagtttgctgccgggcggagatccgtttctggagatctgattctggaaatcggcaagctccctcagcaccttacccagcgggctcaaaatgccctggacaacctggtgatgctccataatagcgagcaggggggacgcgcgtatagacacgccatggaagagctgcccgagacaatcgaaacccttatgctgctcgctctgattgccgtgctgacaggcggcgtcaccctcttctttctttccgggcggggactgggcaaaacgagcatcgggctgctctgtgtgatggcttcttccgccctgctttggatggccagcgttgagcctcattggattgctgcgtctatcattctggaattctttctcatggtgctgctgatccccgagccggatcgccagagaacacctcaggacaaccaactcgcctacgtcgtgatcggacttctgttcatgattctgaccgtcgctgccaatgagatgggcctcctggaaaccacaaagaaggatcttgggatcggacacgtggccgttgagaaccaccatcacgctaccatgctggacgtggatctccatcccgcctccgcgtggacactgtacgccgtcgctacgaccattatcacacctatgatgcggcacaccattgaaaacacaaccgccaatatcagcctgacggctattgccaaccaggcggccatcctcatgggccttgacaaaggctggcccatctctaagatggatattggggtgcctctgctggctctcggatgctatagccaggttaatcccctgacccttacagccgctgtgctgatgctcgtcgcccattacgctatcattggcccggggctgcaagccaaagcgacccgcgaggcccagaagagaacagctgccggaatcatgaaaaaccctaccgtggacggcattgtggctatcgatctggaccccgttgtctatgatgccaagtttgaaaagcagctcgggcagatcatgcttctgattctgtgtacgtcccaaatcctcctgatgcggacaacctgggccctttgcgagtctattacactggcgaccggacccctcaccacactgtgggagggcagccctggcaaattctggaatacgaccatcgctgtgtccatggccaacatttttcgcgggagctacctggctggagccggcctcgccttctcccttatgaagtctctggggggaggcagacgggggacaggagctcagggcgaaaccctgggcgagaaatggaagagacagctcaatcagctgagcaaatccgaattcaacacatataagcgctctgggatcatggaggtggaccggagcgaagccaaggagggacttagacgcggcgagaccacgaaacacgcggtctcccgggggacagccaagctgagatggtttgttgaacgcaatctcgtgaaaccggagggaaaggtgatcgacctgggctgtgggcggggaggctggtcttactattgcgctggcctgaaaaaggtcaccgaagtgaaggggtacaccaaaggaggccccgggcacgaggaacctattcccatggccacatacggatggaacctcgttaagcttcatagcggcaaagatgtgttctttatccctcccgagaagtgtgacaccctgctgtgcgatattggggagtccagccctaatccgacaatcgaagagggaagaacgctccgcgtcctgaaaatggtggaaccctggcttcggggcaaccaattctgtattaagatcctgaatccttatatgccctctgttgtggagaccctcgagcagatgcagagaaaacacggcgggatgctggtccgcaaccctctgtcccggaatagcacacatgaaatgtactgggtgtcttgcggaaccggcaacattgtgtccgctgtcaatatgacaagcagaatgctcctgaaccgctttaccatggcccacagaaagcccacgtatgagcgggacgttgatcttggggcgggaacccgccacgtggccgtggaaccggaggtcgctaacctggacatcatcggccagagaattgaaaatatcaagcatgagcacaaatctacatggcattacgatgaggacaacccttataagacctgggcctaccacgggtcctatgaagtgaaacccagcggatccgctagctctatggttaatggcgtggtcaagctcctgacaaaaccctgggatgtgattcctatggttacccaaatcgccatgacagacaccacgcccttcggccagcagcgggtgtttaaggagaaggtcgatacaagaacccctaaagctaagcgggggaccgcccaaattatggaagtgacagcgcgctggctttggggattcctgagcagaaacaaaaagccgcggatctgtacgcgcgaggaatttaccagaaaagttcggtccaatgccgctatcggcgccgtgttcgtcgacgagaaccagtggaattctgctaaggaggccgtggaagacgagcgcttttgggatctcgtccatagagaacgggagctgcacaagcaggggaaatgcgccacatgcgtgtacaacatgatgggaaagcgcgaaaaaaagctgggcgagttcgggaaagcgaagggcagcagagctatttggtacatgtggctcggagcccggtttctggagttcgaagcccttggcttcatgaatgaggaccactggttttcccgcgaaaactctctgagcggggttgagggagagggcctccataagctggggtatatccttagagatatttccaaaatccccggaggcaatatgtacgctgacgataccgccgggtgggacacacggattaccgaagatgacctgcagaacgaggctaagatcacagatatcatggaacctgagcacgccctcctggcgacctctattttcaaactgacgtatcaaaataaggtggtccgcgtgcagagacccgccaaaaacggcaccgtgatggacgttatcagccggagagatcagcgcggatccggccaggtggggacatacggactcaatacctttacaaacatggaagctcaactgattcggcagatggagagcgagggcatcttctctccttccgaacttgagacccccaacctggccgaaagagtcctcgactggctggagaagtatggggtggaacgccttaaacggatggctattagcggagatgactgtgttgtgaagccgatcgacgatagatttgccacggcgctgacagccctcaatgacatgggcaaggtccgcaaagatatccctcagtgggagccctctaaggggtggaacgactggcagcaagtgcctttctgctcccatcactttcaccagctgattatgaaagatggccgggagatcgtcgtgccctgtagaaatcaggacgaactggttggacgcgctcgggtgagccagggcgccgggtggtccctcagagagaccgcttgcctgggaaagtcttacgcccaaatgtggcagcttatgtatttccatcgccgggatctgagactcgctgccaacgcgatttgtagcgccgtccctgtggactgggttcccacatcccggaccacgtggagcatccacgctcatcagcaatggatgaccacagaagatatgctgtctgtgtggaatagagtctggattgaggaaaacccgtggatggaggacaaaacccacatctccagctggggcgatgtgccttaccttgggaagcgcgaggaccagtggtgcggatctctgattggcctcacagcccgggccacctgggctacaaatatccaggtggccatcaaccaggttagacgcctgattgggaatgaaaactacctggactatatgaccagcatgaagagatttaaaaatgagtccgatcccgaaggcgcgctctggtga

SEQ ID NO: 18547 - RNA, 9879 nt, synthetic construct
  misc_feature 1..9879: note = derived and/or modified CDS sequence (opt5) from DENV-1__FJ639672__SS-prME
  source 1..9879: mol_type = other RNA
agcgtgaccatgctgctcatgctgatgcccaccgcccttgctttccacctgacgacccggggaggggaacctcatatgatcgtgtccaagcaggaacgggggaaatctctcctgtttaagaccagcgccggcgttaatatgtgcacccttattgcgatggacctgggggagctctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcatttccagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccgttctgcgcaaactttgcattgaagcgaagatcagcaataccacgacagattctagatgtccgacccaaggggaggccaccctggtggaagaacaggacgctaacttcgtgtgccggcgcacatttgtcgatagaggatggggcaatggctgtggactcttcggaaaaggctccctgattacctgcgccaagtttaagtgcgtgacaaaacttgaggggaagatcgttcagtacgaaaacctgaaatatagcgtgatcgtcacggtgcacaccggagaccagcatcaagttggcaatgagtctacagaacacgggaccacagctaccattacgccccaggcccctaccacagagatccagctcaccgactacggagccctgacactggattgtagcccccggaccggcctcgacttcaacgaaatggtgctgcttacgatgaaggagaaaagctggctggtccataagcagtggtttctcgatctgcctcttccctggacatccggcgcttctaccagccaagagacatggaatcgccaggacctgctcgtgaccttcaaaaccgcgcacgccaagaagcaggaagtcgtggttctggggtcccaagagggagctatgcacacagccctgacgggcgccaccgaaattcagacaagcgggaccacaaccatctttgctggacatctcaaatgcagactgaagatggataaacttacgctgaagggcatgtcttatgtgatgtgtacagggtccttcaaactcgagaaggaagtcgccgagacccagcacggcaccgtgctggttcagattaagtacgagggaacagacgcgccgtgcaaaatccctttcagcacccaagatgaaaagggcgtgacacagaacgggcggctgatcacggctaatcccattgtcaccgacaaagagaagcctgtgaacatcgaagccgagccgccctttggagagtcttatattgtgatcggcgccggggaaaaagctcttaagctcagctggttcaagaaaggatcctctattggcaagatgtttgaggccacagctagaggggcccgccggatggcgatcctgggcgataccgcctgggacttcggaagcatcggcggggtttttacatccgtcggaaaactggtgcatcagattttcggcaccgcttacggggtgctctttagcggagtctcttggacgatgaagatcggcattggggtgctgcttacctggctgggcctcaattccagaagcacatctctgtccatgacctgtatcgccgttggactggtgacactttacctcggcgtcatggtgcaggctgatagcgggtgcgttattaactggaaaggacgcgaactgaagtgtggctccgggatcttcgtgaccaatgaggtccacacatggaccgaacaatataagtttcaggccgactctcctaaacggctgagcgcggccattggaaaggcttgggaggagggcgtgtgcgggatcagatccgccacgcgcctcgaaaacatcatgtggaaacagatttctaacgagctgaatcatatccttctggaaaacgacatgaagctcacagttgtggtcggcgatgtggctggcattctggcccagggcaaaaagatgatccggccgcaacccatggagtacaaatatagctggaagtcctgggggaaggccaaaattatcggagctgacgtgcagaataccaccttcatcattgatggccctaacacacccgaatgtcctgacgatcagagagcgtggaatatctgggaggtcgaggactacgggtttggaattttcaccacgaacatctggctgaaacttcgcgatagctatacacaggtttgcgaccaccggctcatgtctgccgctattaaagattccaaggccgtgcacgccgacatgggctactggatcgaaagcgagaaaaatgaaacctggaagctggctagagcctcttttatcgaggtgaagacatgtatttggcccaaatcccataccctgtggagcaacggcgtcctcgaatctgagatgatcattccgaagatctatgggggacctattagccaacacaattaccgccccggctacttcacacagaccgcggggccttggcatctgggaaaacttgagctggatttcgacctctgcgaaggcacgaccgtggttgtggatgagcactgcgggaaccggggaccctccctgagaacaaccacagtcaccggcaagatcatccacgaatggtgttgccggagctgtacgctgcctccccttcgctttagaggcgaggacgggtgctggtatggaatggagattcggccggtgaaagaaaaggaggaaaatctcgttaagtctatggtgtccgctggcagcggggaggtcgactccttctctctgggactgctctgtatcagcattatgatcgaagaggtgatgagatcccgctggtctcggaaaatgctgatgacaggcacccttgccgtctttttcctgctcattatggggcagctgacatggaacgatctgatcagactttgcattatggtgggagccaatgctagcgaccgcatgggcatgggcaccacctacctggccctcatggcgacatttaagatgagacctatgttcgctgtcgggctgctctttcggcgcctgacgtccagagaggtgcttctgctcaccatcggactgtctctggtggccagcgtcgaacttcccaactccctggaggaactcggcgatgggctggccatgggaatcatgattctcaaactgcttacagacttccaaagccatcagctgtgggctaccctcctgtctctgacatttatcaagaccacgttctcccttcactatgcctggaaaacaatggctatggttctgagcattgtgtctctctttcccctgtgtctctccaccaccagccagaagacaacctggctgcctgtgcttctgggctctctggggtgcaagccgctcacaatgttcctgatcgccgagaataaaatttggggacggaagtcctggccccttaacgaaggcatcatggcggtcggcatcgtgagcattctgctctccagcctgctcaaaaacgatgttcctctggccgggccccttatcgctggaggcatgctgattgcctgttacgtgatctctgggagctccgctgacctgtctctcgagaaggccgccgaggtcagctgggaagaggaagctgagcattccggagcgtctcacaatattctggtggaagttcaggatgacggcacgatgaaaatcaaggatgaggagcgcgacgatacccttacaatcctgctcaaagccaccctgctcgctgtgagcggggtctatcctctgtccattcccgccacactttttgtgtggtacttctggcaaaagaagaaacagagatctggagtcctgtgggacaccccttcccctcccgaagtggagcgggccgttctggatgacggcatctatcgcattatgcagagaggcctcctggggcggtcccaggtgggagtcggcgtgttccaagaaaacgtttttcatacgatgtggcacgtgacccgcggggctgtccttatgtaccagggaaagagactggagcccagctgggcctctgtgaaaaaggacctcatctcctacggcgggggatggcggctgcagggcagctggaatacaggcgaggaagtgcaggttattgcggtcgagcccgggaaaaaccctaagaatgtgcaaaccgctcccggaacattcaagaccccggaaggcgaggtgggggccatcgccctcgattttaaacctggaacatctggctcccccattgtcaacagagaagggaagatcgtgggactgtatggcaatggcgttgtgacgaccagcgggacatacgtctccgctatcgcccaggcgaaggcttctcaggagggacctcttcccgagattgaagacgaggtgttccgcaagcggaacctgaccatcatggatctgcaccccggcagcgggaaaaccagacgctatctccctgccattgttcgggaagccatcaagagaaagctgcgcacacttattctggctccgacgcgggtggtcgcctccgagatggctgaagccctcaaaggaatgcccatcagataccaaaccacagcggtcaagagcgagcataccggcaaagagatcgttgacctgatgtgccacgccacatttaccatgcgcctgctctctcctgtgcgggtccccaattataacatgattatcatggatgaagctcatttcacggacccttccagcattgccgctagagggtacatctctacacgggtgggcatgggagaggccgccgctatttttatgaccgcgacaccccctggcagcgtggaagccttcccgcagtccaatgctgtcatccaggatgaggaacgcgacatccccgagagatcttggaacagcgggtatgagtggattacagattttcctggaaagaccgtttggttcgtgccctccatcaaatctggcaatgacattgccaactgtcttcggaagaatgggaagcgcgtgatccagctgagcagaaaaacatttgataccgaataccaaaagacgaaaaacaacgactgggactacgtcgtgacaaccgatatttccgagatgggagccaatttccgggctgacagagttatcgatcctcgccggtgcctgaagcccgtgattctcaaagacggcccggaaagagtcatcctggccgggcctatgcccgtgacagttgcgagcgctgcccagcgccggggcagaatcggacgcaaccacaataaggagggcgatcagtatatttacatggggcagccccttaacaatgacgaggatcatgcccactggaccgaagctaagatgctgctcgacaacatcaatacgcctgagggaattatccccgccctgttcgaacctgagcgggaaaaatctgcggccattgatggcgagtatagactgcgcggggaggctagaaagacctttgtggaactcatgcggcgcggagaccttccggtctggctgtcctacaaagtggccagcgagggcttccaatattccgatagacggtggtgctttgacggggaacgcaacaatcaggtcctggaggaaaacatggatgtggagatctggacaaaggagggcgaacgcaaaaagctccggcccagatggctggacgctcgcacctactctgaccctcttgccctgcgggagttcaaagaatttgctgccggaagacgcagcgtttccggcgatctcatcctggagattgggaagctgccccagcacctcacacagcgggcgcaaaatgcccttgacaacctggtgatgctgcataattctgaacagggaggcagagcttatcggcacgccatggaggagctccctgataccatcgaaacactgatgcttctggctctcattgccgtgctgaccgggggagtcacgctgttctttctcagcggccgcggccttgggaagacatccatcggactgctgtgtgttatggccagctctgtgctcctgtggatggcttccgtggagccccattggattgcggccagcatcatccttgagttctttctgatggtcctcctgattccggagcctgacagacagcggacaccccaggataaccaactggcttacgtggttatcggcctccttttcatgattctgaccgtggccgccaatgagatggggctgctcgaaacaaccaaaaaggacctgggaatcggccacgtcgctgtggagaaccaccatcacgccgcgatgcttgatgtcgacctgcatcctgcctctgcttggacactctacgccgtggctacgaccattatcacacccatgatgcgccacaccattgaaaacacaaccgccaatatctccctgacggcgatcgccaaccaggctgccattctgatggggctcgataaaggatggcctatcagcaagatggacattggcgttccccttctggctctgggctgctattctcaggtgaatccgctcaccctgacagccgctgtccttatgctggtggcccattacgcgatcattgggcctggactccaagccaaagctaccagagaggcccagaagcggacagctgccggcatcatgaagaaccccaccgttgatgggatcgtggccattgacctggatcccgtcgtgtatgacgcgaaatttgaaaagcagctgggacagatcatgctccttattctgtgtacgagccaaatcctgctcatgcgcacaacctgggctctgtgcgagtccattacacttgccaccggccctctgaccacactctgggaggggtctccgggaaaattctggaatacgaccatcgctgtgagcatggccaacatctttagaggctcctacctggccggcgctgggctggccttcagcctcatgaagtcccttggaggcgggcggcgcggaacaggcgcgcagggggaaaccctgggagagaaatggaagagacagctgaatcagctctctaagagcgagttcaacacatataaacggtccggcattatggaggttgacagatctgaagccaaggagggcctgaaacgcggggagaccacgaagcacgctgtcagccggggaacagccaaacttagatggtttgtggaacgcaatctggtgaagcccgagggcaaggtcatcgatctcgggtgtggacggggcgggtggtcctactattgcgctggactgaaaaaggttaccgaagtgaaaggctacaccaagggcgggcctggacacgaggaacccattcctatggccacatacggctggaacctggtgaaactccattctgggaaggacgcgttctttattccccctgagaaatgtgatacccttctgtgcgacatcggagagagctccccgaatcccacaatcgaagagggcagaacgctgcgcgtcctcaagatggtggaaccttggctgcgggggaaccaattctgtattaagatccttaatccctatatgcctagcgttgtggagaccctggagcagatgcagagaaaacacggaggcatgctcgtccgcaaccccctgtctagaaattccacacatgaaatgtactgggtgagctgcggcaccgggaacatcgtttctgccgtgaatatgacatccagaatgctgctcaaccgctttaccatggctcaccggaagccgacgtatgagagagatgtcgacctgggaaccggcacacgccacgtggccgtggaacctgaggtcgctaaccttgatattatcgggcagagaattgaaaatatcaaacatgagcacaagagcacctggcattacgacgaggataacccctataaaacatgggcctaccacggatcttatgaagttaagccctccggcagcgcttccagcatggtgaatggggtggtcaagctgctcaccaaaccttgggacgtgattcccatggttacacaaatcgccatgaccgatacgacacctttcggacagcagcgggtgtttaaggagaaagtcgacacccgcaccccgaaggcgaaaagaggcacagcccaaatcatggaagtgacggctcggtggctgtggggcttcctttctagaaacaagaagccccggatttgtacccgcgaggaatttacaagaaaagttcggagcaatgccgctatcggggccgtgttcgtcgacgagaaccagtggaactccgccaaggaggcggtggaagatgagcgcttttgggacctggttcatagagaacgggagctccacaaacagggaaagtgcgctacctgcgtgtacaacatgatgggcaaacgcgaaaagaagctgggggagttcggaaaagccaagggctctagagccatttggtacatgtggctgggggctcggtttctcgagttcgaagccctgggcttcatgaatgaggatcactggtttagccgcgaaaactccctttctggagtcgagggcgaggggctgcataaactcggatatatcctgagagacattagcaagatccctggcgggaatatgtacgctgatgacacagccggatgggatacccggatcacagaagacgatcttcagaacgaggcgaaaattaccgacatcatggaacccgagcacgccctgctcgctaaggccattttcaaactgacgtatcaaaataaggtggtccgcgtgcagagacctgctaagaacggcaccgttatggatgtgatctcccggcgcgaccagagagggtctggccaggtcggaacatacggcctgaatacctttacaaacatggaagcccaactcattcggcagatggagagcgaggggatcttctcccccagcgaactggagaccccgaaccttgcggaaagagccctggattggctcgagaaatatggagtggaacgcctgaagcggatggctatctctggcgacgactgtgtggttaaacctattgatgacagatttgccacggctcttacagccctgaatgatatggggaaggtgcgcaaagacatcccccagtgggagccttccaagggatggaacgattggcagcaagtccccttctgcagccatcactttcaccagctcattatgaaggacggccgggagatcgtggttccttgtagaaatcaggatgaactggtggggcgcgctcgggtctctcagggcgccggatggtccctgagagagaccgcgtgcctcggcaaaagctacgcccaaatgtggcagctgatgtatttccatcgccgggaccttagactggctgccaacgccatttgttccgctgtgcccgtcgattgggtgccgacatctcgcaccacgtggagcatccacgcccatcaccagtggatgaccacagaagacatgctctccgtttggaatcgggtgtggattgaggaaaacccttggatggaggataagacccatatcagctcttgggaggacgtcccctacctggggaaaagagaagaccaatggtgcggatcccttatcggcctgacagcgcgggctacctgggccacaaatattcaggtggccatcaaccaggttagacgcctcattgggaatgagaactacctggattatatgaccagcatgaagcggtttaaaaatgaatctgaccccgagggagctctgtggtga

SEQ ID NO: 18548 - RNA, 9879 nt, synthetic construct
  misc_feature 1..9879: note = derived and/or modified CDS sequence (opt5) from DENV-1__FJ639673__SS-prME
  source 1..9879: mol_type = other RNA
tccgtgaccatgctgctcatgctgatgcccacggcccttgctttccacctgacgaccagaggaggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccgcgcatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagcgggtggaaacatgggccctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaagacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctacctctgagatccagctcacagactacggcgccctgaccctggattgtagcccccggacaggcctcgacttcaacgaaatggtcctgcttaccatgaaggagaaaagctggctggtgcataagcagtggtttctcgatctgcctcttccctggacgtccggggcctctacaagccaagagacctggaatcgccaggacctgctcgtcacattcaaaaccgctcacgcgaagaagcaggaagtggttgtgctgggatcccaagagggcgccatgcacaccgctctgacaggggccacggaaattcagaccagcggaacaaccacaatctttgccggccatctcaaatgcagactgaagatggataaacttaccctgaaggggatgtcttatgtcatgtgtacgggctccttcaaactcgagaaggaagtggctgagacacagcacggaaccgttctggtgcagattaagtacgagggcaccgacgccccgtgcaaaatccctttcagcacacaagatgaaaagggggtcacccagaacggacggctgatcacagcgaatcccattgtgacggacaaagagaagcctgtgaacatcgaagctgagccgccctttggcgagtcttatattgttatcggggccggagaaaaagcccttaagctcagctggttcaagaaaggctcctctattgggaagatgtttgaggctaccgccagaggcgctcgccggatggccatcctgggagatacagcgtgggacttcggcagcatcgggggagtctttacctccgtgggcaaactggtgcatcagattttcgggacagcctacggagtcctctttagcggcgtgtcttggaccatgaagatcgggattggcgttctgcttacgtggctgggactcaattccagaagcacctctctgtccatgacatgtatcgctgtgggcctggtcaccctttacctcggggtgatggttcaggccgatagcggatgcgtgattaactggaaaggccgcgaactgaagtgtgggtccggaatcttcgtcacaaatgaggtgcacacctggacagaacaatataagtttcaggctgactctcctaaacggctgagcgccgcgattggcaaggcctgggaggagggggtttgcggcatcagatccgctacccgcctcgaaaacatcatgtggcggcagatttctaacgagctgaatcatatccttctggaaaacgacatgaaattcacggtggtcgtgggagatgtggtcggcattctcgcccaggggaagaaaatgatcagaccgcaacccatggagcacaagtacagctggaaatcctggggaaaggctaagattatcggcgccgacgttcagaatacaacctttatcattgatgggcctaacacccccgaatgtcctgacgatcagcgcgcctggaatatctgggaggtggaggactatggattcggcatttttacaaccaacatctggctgaaactgcgggatagctacacacaggtgtgcgaccacagacttatgtctgctgcgattaaggattccaaagccgtccatgctgacatgggctattggatcgaaagcgagaagaatgaaacatggaaactcgcccgcgcctctttcatcgaggtgaagacctgtatttggcccaagtcccacacactgtggagcaacggggttctggaatctgagatgatcattccgaaaatctacggaggccctattagccaacataattatcggcccgggtacttcacccagacagctggaccttggcacctcggcaagctggagcttgattttgacctgtgcgaagggaccacggtggtcgtggatgagcactgcggaaacagaggcccctccctccggaccacaaccgttacaggcaaaatcatccatgaatggtgttgccgcagctgtaccctgcctcccctgagattcaagggggaggacggatgctggtacggcatggagattcggccggtgaaagaaaaggaggaaaatcttgtcaagtctatggtgtccgccgggagcggagaggttgactccttttctctcggcctgctgtgtatcagcattatgatcgaagaggtgatgagatcccgctggtctcggaaaatgctcatgacggggacactggcggtcttctttcttctgattatgggacagctcacctggaacgatctgatcagaagctgcattatggtgggcgctaatgcctccgaccgcatgggcatggggacaacctatctggcccttatggctaccttcaagatgagacctatgtttgccgtgggactcctgttccggcgcctgacatctagagaggtcctcctgcttacgatcggcctgagcctcgttgcgtccgtggaactgcccaacagcctggaggaacttggggatggactggctatgggcatcatgattctcaaactgctcaccgactttcaatcttaccagctgtgggccacacttctgtccctcaccttcatcaagacaacctttagcctgcactatgcctggaaaacgatggctatggtgctgtctattgtctcccttctgcccctctgtctgagcacaacctctcagaagaccacatggctccctgtgctgcttgggtccctgggatgcaagccgctgaccatgttcctcatcgccgagaataaaatttggggccggaagtcctggcccctgaacgaaggcatcatggctgttgggatcgtgtccattcttctgagctctctcctgaaaaacgatgtccctctcgccggacccctgatcgcgggcgggatgcttattgcctgttacgtgatcagcggatcctctgctgacctgagcctggagaaggccgctgttgtgtcctgggaggaagaggccgaacattctggcgccagccacaatattctcgtcgaggtgcaggatgacgggacaatgaaaatcaaggatgaagaacgcgacgatacgctgaccatccttctgaaagctacactcctggcggtctccggagtgtatcctctctctattcccgccaccctgtttgtttggtacttctggcaaaagaagaaacagagaagcggcgtgctttgggacacacctagccctcccgaggtcgaacgggctgtgctggatgacggcatctatcgcattatgcagagagggctgctcggacggagccaggttggcgtgggggtcttccaagagaacgtgtttcataccatgtggcacgtgacgcgcggagccgttctgatgtaccagggcaagagacttgaaccctcttgggcctccgtcaaaaaggacctgatcagctacgggggaggctggcggctccagggctcttggaataccggggaggaggtccaggtgattgctgtcgaacccggcaagaatcctaagaatgtgcaaacagcccccggcaccttcaagacaccggagggggaagttggagcgatcgctctggattttaaacctggcacctccgggagccccattgtgaacagagagggaaagatcgtcggcctctatggcaatggggtggttacaacgtccggaacctacgtgtctgccatcgcccaggctaaagccagccaggaaggccctctgcccgagattgaggacgaagtcttccgcaagcggaaccttacaatcatggatctgcaccccgggtccggaaaaaccagacgctatctgcctgcgattgtgcgggaggctatcaagagaaagctccgcaccctgattcttgccccgacacgggttgtggccagcgaaatggctgaggccctgaaaggcatgcccatcagataccaaacgaccgctgtcaagtctgaacatacagggcgcgagatcgtggacctcatgtgccacgccacctttacaatgcggctgctgtcccctgtgagagtccccaattataacatgattatcatggatgaggcgcatttcaccgaccctagctctattgccgctcggggctacatcagcacgcgcgttggaatgggcgaagccgctgccatttttatgacagccacaccccctgggtccgtggaggctttcccgcagtctaatgcggtgatccaggatgaagagagagacatccccgaacggagctggaactccggatatgagtggattaccgattttcctggcaaaacagtctggttcgtgccctctatcaagagcgggaatgacattgccaactgtctccgcaaaaatggaaagagagttatccagctttcccggaagacctttgatacagagtaccagaaaaccaagaacaacgactgggactacgtggtcacgacagatattagcgaaatgggcgctaatttcagagccgaccgcgtgatcgatcctcggagatgcctgaaacccgttattctgaaggacgggccggagcgcgtgatcctcgccggccctatgcccgtcaccgtggcttctgccgcgcagcggagaggacgcatcggccggaaccacaataaagaaggggatcagtatatttacatgggacagcccctgaacaatgacgaggatcatgctcactggacagaggccaagatgcttctggacaacatcaatacccctgaaggcattatccccgccctcttcgagcctgaaagagagaagtccgctgccattgatggggaatatcgcctgagaggagaggcgcggaaaacgtttgtcgagctgatgcgcagaggcgacctcccggtgtggcttagctacaaggttgcctccgaagggttccaatattctgatcggcgctggtgctttgacggcgagagaaacaatcaggtgctggaagagaacatggatgtggaaatctggaccaaagagggagagcggaagaaactgagaccccgctggctcgacgctcggacatacagcgaccctctggcccttagagagttcaaggagtttgctgccggccgccggtccgtctctggggatctgatcctcgaaattggaaaactgccccagcacctgacccagagagctcaaaatgccctcgacaaccttgttatgctgcataatagcgagcagggcgggcgggcgtatcgccacgccatggaggaactgcctgatacaatcgagaccctcatgctgcttgctctgattgccgtgctcacaggaggcgtgaccctgttctttctgtccggcagagggctcggaaagacgagcatcggccttctgtgtgtcatggcttcttccgccctgctctggatggccagcgtggaaccccattggattgctgcgtctatcatcctggagttctttcttatggttctgctcattccggaacctgaccggcagcgcacaccccaggataaccaactggcctacgtggtcatcgggctcctgttcatgattcttaccgtggctgccaatgagatgggactgctggagaccacaaagaaagacctcggcatcgggcacgtcgccgtggaaaaccaccatcacgctaccatgctggatgttgaccttcatcctgcctccgcgtggacactgtacgccgtggctacgaccattatcacacccatgatgagacacaccattgagaacacaaccgccaatatcagcctcacggctatcgccaaccaggcggccattctgatgggactggataagggctggcctatctctaaaatggacattggcgtccccctccttgctctggggtgctatagccaggtgaatccgctgaccctcacagccgctgttctgatgcttgtggcccattacgctatcattggacctggcctgcaagccaaggcgacccgggaagcccagaaacgcacagctgccgggatcatgaagaaccccaccgtcgatggaatcgtggctattgacctcgatcccgtggtttatgacgccaagtttgagaaacagctgggccagatcatgctgctcattctttgtacgtcccaaatcctgctgatgagaacaacctgggccctctgcgaatctattacactggcgaccgggcctcttaccacactgtgggagggaagcccgggcaagttctggaatacgaccatcgctgtctccatggccaacatctttcggggcagctacctcgctggggccggactggccttctccctgatgaaatctctcggcgggggacgcagaggcacaggggctcagggagagacccttggcgaaaagtggaaacggcagctgaatcagctgagcaagtccgagttcaacacatataagagatctggcattatggaagtggaccgcagcgaggccaaagaagggctccggagaggagagaccacgaagcacgcggtgtcccgcggcacagccaaactgcggtggtttgtcgagagaaatcttgttaagcccgaagggaaagtgatcgatctgggatgtggccgcgggggatggtcttactattgcgctggcctcaagaaggtgaccgaggtcaaaggctacaccaaagggggacctggccacgaggaacccattcctatggccacatacgggtggaacctggtgaaactgcatagcggaaaggacgttttctttattccccctgaaaaatgtgataccctcctttgcgacattggcgagtccagcccgaatcccacaatcgaggaagggcggacgctgagagtgctgaagatggtcgagccttggctccgcggaaaccaattctgtattaaaatcctgaatccctatatgccttctgtggttgaaacccttgagcagatgcagcggaagcacggcggcatgctggtgagaaaccccctctcccgcaatagcacacatgagatgtactgggtctcttgcgggaccggaaacatcgtgtccgctgtgaatatgacaagccggatgctgctgaacagatttaccatggcccaccgcaagccgacgtatgaaagagatgtcgacctcggcgcggggacccggcacgttgccgtggagcctgaagtggctaacctggatattatcggacagcgcattgagaatatcaaacatgaacacaagtctacatggcattacgacgaggataacccctataaaacctgggcctaccacggctcctatgaggtcaagcccagcgggtccgctagctctatggtgaatggagttgtgaaacttctgacaaagccttgggacgtcattcccatggtgacccaaatcgccatgacagataccacgcctttcggccagcagagagtttttaaggaaaaagtggacacacggaccccgaaggctaaaagaggcaccgcccaaatcatggaggtcacagcgcggtggctctgggggttcctgagccgcaacaagaaacccagaatttgtacgcgggaagagtttacccgcaaggtgagatccaatgccgctatcggagccgttttcgtggacgaaaaccagtggaactctgctaaggaggccgtcgaggatgaacggttttgggaccttgtgcatcgcgagagagaactgcacaaacagggcaagtgcgccacatgcgtctacaacatgatggggaaacgggagaagaaactcggagagttcggcaaggcgaaggggagccgcgctatttggtacatgtggctgggcgccagatttctggagttcgaggccctcggattcatgaatgaagatcactggttttcccgggagaactctctgagcggcgtggaaggggagggacttcataaactgggctatatcctccgcgacatttccaagatccctgggggaaatatgtacgctgatgacaccgccggctgggatacaagaatcaccgaggacgatctgcagaacgaagctaaaattacagacatcatggagcccgaacacgcccttctggcgacctctattttcaagctcacgtatcaaaataaagttgtgcgggtccagcgccctgccaagaacgggaccgtgatggatgtgatcagcagacgggaccagagaggctccggacaggttggcacatacgggctgaatacctttacaaacatggaggctcaactgattcgccagatggaaagcgagggaatcttctctccctccgagctcgaaaccccgaacctggccgagcgggtgcttgattggctggaaaaatatggcgtcgagagactcaagcgcatggctatcagcggggacgactgtgtggttaagcctattgatgaccggtttgccacggcgctgacagcccttaatgatatgggaaaagtgagaaaggacatcccccagtgggaaccttctaaaggctggaacgattggcagcaagtccccttctgctcccatcactttcaccagctgattatgaaggacgggcgcgagatcgtggtcccttgtcggaatcaggatgagctcgtgggcagagctcgcgttagccagggagccggctggtccctgcgggaaaccgcttgcctggggaaatcttacgcccaaatgtggcagctcatgtatttccatagacgcgacctgcggcttgctgccaacgcgatttgtagcgccgtgcccgtcgattgggtgccgacatccagaaccacgtggagcatccacgctcatcaccagtggatgaccacagaggacatgctgtctgtttggaatcgggtgtggattgaagagaacccttggatggaagataagacccatatctccagctggggagacgtcccctacctcggcaagagagaggaccaatggtgcgggtctctgatcggacttacagcccgcgccacctgggctacaaatattcaggtggccatcaaccaggtgcggagactgattggcaatgagaactacctcgattatatgaccagcatgaaacgctttaagaatgaatccgaccccgagggggcgctgtggtga

SEQ ID NO: 18549 - RNA, 9879 nt, synthetic construct
  misc_feature 1..9879: note = derived and/or modified CDS sequence (opt5) from DENV-1__FJ639674__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcatgtctctctccatgacctgtatcgccgttggcctggtgacactgtaccttggggtcatggtgcaggctgatagcggatgcgttattaactggaaaggccgcgaactcaagtgtgggtccggaatctttgtgaccaatgaggtccacacatggaccgaacaatataagttccaggccgactctcctaaacggctgagcgcggccattggcaaggcttgggaggagggggtgtgcggcatcagatccgccacacgcctggaaaacatcatgtggaaacagatttctaacgagctcaatcatatcctgcttgaaaacgacatgaagtttaccgttgtggtcggagatgtggctggcattctggcccaggggaaaaagatgatccggccgcaacccatggagtacaaatatagctggaagtcctggggaaaggccaaaattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgatagctatacccaggtttgcgaccaccggctgatgtctgccgctattaaagattccaaggccgtgcacgccgacatgggctactggatcgaaagcgagaaaaatgaaacgtggaaacttgctagagcctctttcatcgaggtgaagacatgtatttggcccaaatcccataccctctggagcaacggggtcctggaatctgagatgatcattccgaagatctatggaggccctattagccaacacaattaccgccccgggtactttacacagaccgcgggaccttggcatctgggcaaactcgagctggatttcgacctttgcgaagggacaaccgtggttgtggatgagcactgcggaaaccggggcccctccctgagaacgaccacagtcaccggcaagatcatccacgaatggtgttgccggagctgtacactccctcccctgcgctttaaaggggaggacggatgctggtatggcatggagattagaccggtgaaggaaaaggaggaaaatctggttaaatctatggtgtccgctgggagcggagaggtcgactccttctctcttggcctcctgtgtatcagcattatgatcgaagaggtgatgcggtccagatggtctcgcaagatgctgatgaccgggacgctcgccgtctttttcctgcttattatgggacagctgacatggaacgatctcatccggctgtgcattatggtgggcgccaatgctagcgacagaatgggcatggggaccacatacctggcccttatggcgacctttaaaatgcgccctatgttcgctgtcggactgctctttagacggctgacctcccgcgaggtgctcctgcttacaatcggcctgtctctcgtggccagcgtcgaactgcccaactccctggaggaacttggggatggactggccatgggcatcatgattctcaagctgctcacggacttccaaagccatcagctgtgggctacccttctgtctctcacatttatcaaaaccacattctccctgcactatgcctggaagaccatggctatggttctgagcattgtgtctctttttcccctgtgtctctccacgacaagccagaagaccacctggctgcctgtgctcctggggtctcttggatgcaaaccgctgacaatgttcctgatcgccgagaataagatttggggcagaaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggaccatgaagatcaaagatgaggagcgggacgatacactcacgatcctgcttaaggccaccctgctcgctgtgagcggagtctatcctctgtccattcccgccacactcttcgtgtggtacttttggcaaaagaaaaagcagcgctctggcgtcctgtgggacaccccttcccctcccgaagtggagagagccgttcttgatgacggcatctatcggattatgcagcgcgggctgctgggaagatcccaggtgggcgtcggggtgttccaagaaaacgtttttcatacaatgtggcacgtgacccggggagctgtcctcatgtaccagggcaaacgcctggagcccagctgggcctctgtgaagaaagaccttatctcctacgggggaggctggagactgcagggcagctggaatacgggggaggaagtgcaggttattgcggtcgagcccggaaagaaccctaagaatgtgcaaaccgctcccggcacattcaaaacctctgaaggggaggtgggagccatcgccctcgattttaagccgggcacatccgggagccctattgtcaaccgggaaggaaaaatcgtgggcctgtatggcaatggggttgtgaccacatccggaacgtacgtctctgctatcgcccaggcgaaggctagccaggagggccccctccctgagattgaagacgaggtgttcagaaaacgcaacctgaccatcatggatcttcaccccgggtccggaaagacacggagatatctgcccgccattgttcgcgaagccatcaagcggaaactgagaaccctcattctggctcctacccgcgtggtcgccagcgagatggctgaagcccttaagggcatgccgatccggtaccaaacaacggcggtgaaatctgagcataccgggaaggagatcgttgacctgatgtgccacgccacatttaccatgagactcctgtcccccgtgcgcgtccctaattataacatgattatcatggatgaagctcatttcacagaccccagctctattgccgctcggggctacatcagcaccagagtgggaatgggcgaggccgccgctatttttatgacggcgacacctcccgggtccgtggaagccttccctcagtctaatgctgtcatccaggatgaggaacgggacatcccggagcgcagctggaactccggatatgagtggattaccgattttcccggcaaaaccgtttggttcgtgccttctatcaagagcgggaatgacattgccaactgtctgagaaagaatggaaaacgggtgatccagctctcccgcaagacattcgataccgaataccagaagacaaagaacaacgactgggactacgtcgtgaccacggatattagcgagatgggcgccaattttagagctgaccgggttatcgatcccagacgctgccttaaacctgtgattctgaaggacgggcccgaacgggtcatcctggccggcccgatgcctgtgacagttgcgtctgctgcccagagacgcggacggatcggcagaaaccacaataaggagggggatcagtatatttacatgggacagcccctcaacaatgacgaggatcatgcccactggaccgaagctaaaatgctgcttgacaacatcaatacacccgagggcattatccctgccctgttcgaacccgagcgcgaaaagtccgcggccattgatggggagtatcggctcagaggagaggctcgcaaaacctttgtggaactgatgagacggggcgacctgcctgtctggctcagctacaaggtggcctccgaggggttccaatattctgatcgcagatggtgctttgacggcgaacggaacaatcaggtccttgaggaaaacatggatgtggagatctggacgaaagagggagaacgcaagaaactgagaccgcggtggctggacgctagaacctacagcgaccccctcgccctgcgcgagttcaaggaatttgctgccggccggagatccgtttctggggatcttatcctggagattggaaagctccctcagcacctgacacagcgcgcgcaaaatgccctggacaacctcgtgatgcttcataatagcgaacagggcgggcgggcttatagacacgccatggaggagctgcccgataccatcgaaacactgatgctcctggctcttattgccgtgctgaccggaggcgtcacactcttctttctgtccggccgggggctgggaaaaaccagcatcggcctcctttgtgttatggcctcttccgtgctgctgtggatggctagcgtggagcctcattggattgcggcctctatcatcctcgagttctttctgatggtccttctgattcccgagccggaccgccagagaacgcctcaggataaccaactcgcttacgtggttatcgggctgctgttcatgattctcacagtggccgccaatgagatgggacttctggaaaccaccaagaaagacctgggcatcgggcacgtcgctgtggagaaccaccatcacgccgcgatgctcgatgtcgacctgcatcccgcctccgcttggacactttacgccgtggctaccacaattatcacgcctatgatgcggcacaccattgaaaacacaaccgccaatatcagcctgacagcgatcgccaaccaggctgccattctcatgggactggataagggctggcccatctctaaaatggacattggcgttcctctgctcgctcttgggtgctatagccaggtgaatcccctgaccctgacggccgctgtcctcatgctggtggcccattacgcgatcattggaccgggccttcaagccaaggctacccgcgaggcccagaagagaacagctgccgggatcatgaaaaaccctaccgttgatggaatcgtggccattgacctggatcccgtcgtgtatgacgcgaagtttgaaaaacagctcggccagatcatgctgctgattctctgtacatcccaaatccttctgatgcggaccacgtgggctctgtgcgagtctattacactcgccaccgggcccctgacaaccctttgggagggaagccctggcaagttctggaataccacaatcgctgtgtccatggccaacatcttccgcggcagctacctggccggggctggactcgccttttccctgatgaaatctctgggcgggggaagacggggcacgggggcgcagggagaaaccctcggcgagaagtggaagcgccagcttaatcagctgagcaaatccgagttcaacacatataagagatctggcattatggaggttgaccggagcgaagccaaagaggggctgaagagaggagagaccacaaaacacgctgtctcccgcggcaccgccaagctccggtggtttgtggaaagaaatctggtgaagccggaggggaaagtcatcgatcttggatgtggccgcgggggatggtcttactattgcgctggcctgaagaaagttacggaagtgaagggctacacaaaagggggacccggccacgaggaacctattcccatggccacctacgggtggaacctcgtgaagctgcatagcggaaaagacgtcttctttatccctcccgagaagtgtgataccctgctctgcgacattggcgagtccagccctaatccgacaatcgaagaggggcggacccttagagtgctgaagatggttgaaccctggctgcgcggaaaccaattctgtattaaaatcctcaatccttatatgccctctgtggtcgagacactggagcagatgcagcggaagcacggcggcatgcttgtgagaaaccctctgtcccgcaatagcacgcatgaaatgtactgggtttcttgcgggaccggaaacatcgtgtccgcggtcaatatgacaagccggatgctcctgaacagatttaccatggcccaccgcaaacccacatatgagcgggatgtggacctgggcgctgggaccagacacgtggccgtcgaaccggaggttgctaacctcgatattatcggacagcgcattgaaaatatcaagcatgagcacaaatctacgtggcattacgacgaggataacccttataagacctgggcctaccacggctcctatgaagtgaagcccagcgggtccgctagctctatggtgaatggagtcgtgaaactgcttacaaagccctgggacgttattcctatggtgacccaaatcgccatgacagataccacacccttcggccagcagagagtctttaaagagaaggtggacacccggacgcctaaagcgaagcgcggcacagcccaaatcatggaagttaccgctaagtggctgtgggggttcctcagcagaaacaaaaagccgcggatttgtaccagagaggaatttacacggaaagtgcgctccaatgccgctatcggagccgtcttcgtggacgagaaccagtggaactctgccaaggaggcggttgaagatgagagattttgggacctggtgcatcgggaacgcgagcttcacaaacagggcaagtgcgctacgtgcgtctacaacatgatggggaagagagagaagaagctgggagagttcggcaaagccaaggggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaagatccccgggggaaatatgtacgctgatgacaccgccggctgggatacacgcatcaccgaagacgatctccagaacgaggcgaaaattacagacatcatggaacctgagcacgccctgcttgctaagtctattttcaagctgacctatcaaaataaagtcgtgagagttcagcggcccgtgaagaacgggacagtcatggatgtgatcagccgcagagaccagcggggctccggacaggtgggcacctacgggctcaatacgtttaccaacatggaagcccaactgattcgccagatggagagcgagggaatcttctctccttccgaactggagacacccaacctcgctggcagagttctggattggcttgaaaaacatggggtggagcggctgaagagaatggccatcagcggagacgactgtgtcgtgaaaccgattgatgaccgctttgcgaccgccctcacagctctgaatgatatgggcaaggttcggaaggacatccctcagtgggaaccctctaaagggtggaacgattggcagcaagtgcctttctgctcccaccactttcatcagcttattatgaaggacggcagagagatcgtcgtgccctgtcgcaatcaggatgagctggtcggacgggccagagtgagccagggcgctgggtggtccctccgcgaaaccgcctgcctgggaaaatcttatgctcaaatgtggcagctgatgtacttccaccggagagacctccgcctggccgcgaacgccatttgtagcgctgttcctgtggattgggtccccacgtcccggacaacctggagcatccatgcccaccatcagtggatgacaaccgaggacatgctttctgtgtggaatagagtttggattgaagagaacccgtggatggaagataagacgcacatctccagctggggcgacgtgccttatctggggaaacgcgaggaccaatggtgcggatctctcatcggcctgaccgcccgggctacatgggccaccaatattcaggtcgcgatcaaccaggtgagacggcttattgggaatgagaactacctggattacatgacaagcatgaagagatttaagaatgaatccgaccccgagggcgctctctggtga

SEQ ID NO: 18550 - RNA, 9879 nt, synthetic construct
  misc_feature 1..9879: note = derived and/or modified CDS sequence (opt5) from DENV-1__FJ639675__SS-prME
  source 1..9879: mol_type = other RNA
agcgtgaccatgctgctcatgctgatgcccacagctcttgctttccacctgacgaccagaggcggggaacctcatatgatcgtgtccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggcctgttcaaactcgagaaggaagtcgccgagacacagcacggaaccgtgctggttcagattaagtacgagggcaccgacgcgccgtgcaaaatccctttttccacacaagatgaaaagggggtgacccagaacggacggctgatcacagctaatcccattgtcacggacaaagagaagcctgtgaacatcgaagccgagccgcccttcggcgagagctatattgtgatcggggccggagaaaaagctcttaagctctcttggtttaagaaaggcagctccattgggaagatgttcgaggccaccgctagaggcgcccgccggatggcgatcctgggagatacagcctgggactttggctctatcgggggagttttcaccagcgtcggcaaactggtgcatcagatttttgggacagcttacggagtcctgttctccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatctttgtgacaaatgaggtccacacctggacagaacaatataagttccaggccgactcccctaaacggctgtctagcgcgattggcaaggcctgggaggagggggtgtgcggcatcagatccgctacccgcctcgaaaacatcatgtggaaacagatttctaacgagctgaatcatatccttctggaaaacgacatgaagtttacggttgtggtcggagatgtggccggcattctcgctcaggggaaaaagatgatccggccgcaacccatggagtacaaatatagctggaagtcctggggaaaggccaaaattatcggcgccgacgtgcagaatacaaccttcatcattgatgggcctaacacccccgaatgtcctgacgatcagagagcttggaatatctgggaggtcgaggactacggatttggcattttcacaaccaacatctggctgaagctgcgcgatagctatacgcaggtttgcgaccaccggcttatgtctgcggccattaaagattccaaggctgtgcacgccgacatgggctactggatcgaaagcgagaaaaatgaaacatggaagctcgccagagcttctttcatcgaggtgaagacctgtatttggcccaaatcccatacactgtggagcaacggggtcctggaatctgagatgatcattccgaagatctatggaggccctattagccaacacaattaccgccccgggtactttacccagacagccggaccttggcatctcggcaaactggagcttgatttcgacctgtgcgaagggaccacggtggttgtggatgagcactgcggaaaccggggcccctccctcagaaccacaaccgtcacaggcaagatcatccacgaatggtgttgccggagctgtaccctgcctcccctgcgctttaaaggggaggacggatgctggtatggcatggagattagaccggtgaaggaaaaggaggaaaatcttgttaaatctatggtgtccgcggggagcggagaggtcgactccttctctctcggcctgctgtgtatcagcattatgatcgaagaggtgatgcggtccagatggtctcgcaagatgctcatgacggggacactggctgtctttttccttctgattatgggacagctcacctggaacgatctgatccggctgtgcattatggtgggcgccaatgccagcgacagaatgggcatggggatgacataccttgctctgatggccacctttaaaatgcgccctatgttcgcggtcggactcctgtttagacggctcacctcccgcgaggtgctgcttctgacaatcggcctctctctggtggctagcgtcgaactgcccaactcccttgaggaactgggggatggactcgccatgggcatcatgattctgaagctcctgacggacttccaaagccatcagctttgggccaccctgctctctctgacatttatcaaaaccacattctccctgcactatgcttggaagaccatggccatggttcttagcattgtgtctctgtttcccctctgtctgtccacgacaagccagaagaccacctggctccctgtgctgcttgggtctctgggatgcaaaccgctgacaatgttcctcatcgctgagaataagatttggggcagaaaatcctggcccctgaacgaaggcatcatggccgtcgggatcgtgagcattcttctgtccagcctcctgaagaacgatgttcctctcgcgggacccctgatcgccggcgggatgcttattgcttgttacgtgatctctggaagctccgccgacctgtctctggagaaagctgccgaggtcagctgggaagaggaagccgagcattccggcgcttctcacaatattctcgtggaagttcaggatgacgggaccatgaagatcaaagatgaggagcgggacgatacactgacgatccttctgaaggcgaccctcctggccgtgagcggagtctatcctctctccattcccgctacactgttcgtgtggtacttttggcaaaagaaaaagcagcgctctggcgtcctttgggacaccccttcccctcccgaagtggagagagccgttctggatgacggcatctatcggattatgcagcgcgggctgctcggaagatcccaggtgggcgtcggggtgttccaagaaaacgtttttcatacaatgtggcacgtgacccggggagccgtcctgatgtaccagggcaaacgccttgagcccagctgggcttctgtgaagaaagacctgatctcctacgggggaggctggagactccagggcagctggaatacgggggaggaagtgcaggttattgccgtcgagcccggaaagaaccctaagaatgtgcaaaccgcgcccggcacattcaaaacctctgaaggggaggtgggagctatcgccctggattttaagccgggcacatccgggagccctattgtcaaccgggaaggaaaaatcgtgggcctctatggcaatggggttgtgaccacatccggaacgtacgtctctgccatcgctcaggccaaggcgagccaggagggccccctgcctgagattgaagacgaggtgttcagaaaacgcaaccttaccatcatggatctgcaccccgggtccggaaagacacggagatatctgcccgctattgttcgcgaagccatcaagcggaaactcagaaccctgattcttgcccctacccgcgtggtcgctagcgagatggccgaagctctgaagggcatgccgatccggtaccaaacaacggccgtgaaatctgagcataccgggaaggagatcgttgacctcatgtgccacgcgacatttaccatgagactgctgtcccccgtgcgcgtccctaattataacatgattatcatggatgaagcccatttcacagaccccagctctattgctgcccggggctacatcagcaccagagtgggaatgggcgaggctgccgccatttttatgacggctacacctcccgggtccgtggaagcgttccctcagtctaatgccgtcatccaggatgaggaacgggacatcccggagcgcagctggaactccggatatgagtggattaccgattttcccggcaaaaccgtttggttcgtgccttctatcaagagcgggaatgacattgctaactgtctcagaaagaatggaaaacgggtgatccagctttcccgcaagacattcgataccgaataccagaaaacaaagaacaacgactgggactacgtcgtgaccacggatattagcgagatgggcgccaattttagagccgaccgggttatcgatcccagacgctgcctgaaacctgtgattctgaaggacgggcccgaacgggtcatcctcgctggcccgatgcctgtgacagttgcctctgcggctcagagacgcggacggatcggcagaaaccacaataaggagggggatcagtatatttacatgggacagcccctgaacaatgacgaggatcatgcccactggaccgaagccaaaatgcttctggacaacatcaatacacccgagggcattatccctgctctcttcgaacccgagcgcgaaaagtccgccgcgattgatggggagtatcggctgagaggagaggcccgcaaaacctttgtggaactgatgagacggggcgacctccctgtctggcttagctacaaggtggcttccgaggggttccaatattctgatcgcagatggtgctttgacggcgaacggaacaatcaggtcctggaggaaaacatggatgtggagatctggacgaaagagggagaacgcaagaaactgagaccgcggtggctcgacgccagaacctacagcgaccccctggcccttcgcgagttcaaggaatttgccgctggccggagatccgtttctggggatctgatcctcgagattggaaagctgcctcagcacctgacacagcgcgcccaaaatgcgctcgacaaccttgtgatgctgcataatagcgaacagggcgggcgggcctatagacacgctatggaggagctgcccgataccatcgaaacactcatgctgcttgccctgattgctgtgctcaccggaggcgtcacactgttctttctgtccggccgggggctcggaaaaaccagcatcggccttctgtgtgttatggcctcttccgtgctgctctggatggccagcgtggagcctcattggattgctgcgtctatcatcctggagttctttcttatggtcctgctcattcccgagccggaccgccagagaacgcctcaggataaccaactggcctacgtggttatcgggctcctcttcatgattcttacagtggctgccaatgagatgggactgctggaaaccaccaagaaagacctcggcatcgggcacgtcgccgtggagaaccaccatcacgctgccatgctggatgtcgaccttcatcccgcgtccgcctggacactgtacgctgtggccaccacaattatcacgcctatgatgcggcacaccattgaaaacacaaccgctaatatcagcctcacagccatcgcgaaccaggccgctattctgatgggactggataagggctggcccatctctaaaatggacattggcgttcctctccttgccctggggtgctatagccaggtgaatcccctgaccctcacggctgccgtcctgatgcttgtggctcattacgccatcattggaccgggcctgcaagcgaaggccacccgcgaggctcagaagagaacagccgctgggatcatgaaaaaccctaccgttgatggaatcgtggccattgacctcgatcccgtcgtgtatgacgccaagtttgaaaaacagctgggccagatcatgctgctcattctttgtacatcccaaatcctgctgatgcggaccacgtgggcgctctgcgagtctattacactggctaccgggccccttacaaccctgtgggagggaagccctggcaagttctggaataccacaatcgccgtgtccatggctaacatcttccgcggcagctacctcgccggggccggactggctttttccctgatgaaatctctcggcgggggaagacggggcacgggggcccagggagaaacccttggcgagaagtggaagcgccagctgaatcagctgagcaaatccgagttcaacacatataagagatctggcattatggaggttgaccggagcgaagcgaaagaggggctcaagagaggagagaccacaaaacacgccgtctcccgcggcaccgctaagctgcggtggtttgtggaaagaaatcttgtgaagccggaggggaaagtcatcgatctgggatgtggccgcgggggatggtcttactattgcgccggcctcaagaaagttacggaagtgaagggctacacaaaagggggacccggccacgaggaacctattcccatggctacctacgggtggaacctggtgaagctgcatagcggaaaagacgtcttctttatccctcccgagaagtgtgataccctcctttgcgacattggcgagtccagccctaatccgacaatcgaagaggggcggaccctgagagtgctgaagatggttgaaccctggctccgcggaaaccaattctgtattaaaatcctgaatccttatatgccctctgtggtcgagacacttgagcagatgcagcggaagcacggcggcatgctggtgagaaaccctctctcccgcaatagcacgcatgaaatgtactgggtttcttgcgggaccggaaacatcgtgtccgccgtcaatatgacaagccggatgctgctgaacagatttaccatggcgcaccgcaaacccacatatgagcgggatgtggacctcggcgccgggaccagacacgtggctgtcgaaccggaggttgccaacctggatattatcggacagcgcattgaaaatatcaagcatgagcacaaatctacgtggcattacgacgaggataacccttataagacctgggcttaccacggctcctatgaagtgaagcccagcgggtccgccagctctatggtgaatggagtcgtgaaacttctgacaaagccctgggacgttattcctatggtgacccaaatcgctatgacagataccacacccttcggccagcagagagtctttaaagagaaggtggacacccggacgcctaaagccaagcgcggcacagcgcaaatcatggaagttaccgccaagtggctctgggggttcctgagcagaaacaaaaagccgcggatttgtaccagagaggaatttacacggaaagtgcgctccaatgctgccatcggagctgtcttcgtggacgagaaccagtggaactctgccaaggaggccgttgaagatgagagattttgggaccttgtgcatcgggaacgcgagctgcacaaacagggcaagtgcgcgacgtgcgtctacaacatgatggggaagagagagaaaaagctcggagagttcggcaaagctaaggggagccgggccatttggtacatgtggctgggcgcccgcttcctggagtttgaagctctcggattcatgaatgaggatcactggttttccagagaaaactctctgagcggcgtggagggggagggacttcataaactgggctatatcctccgggacatttccaagatccccgggggaaatatgtacgccgatgacaccgctggctgggatacacgcatcaccgaagacgatctgcagaacgaggccaaaattacagacatcatggaacctgagcacgcgcttctggccaagtctattttcaagctcacctatcaaaataaagtcgtgagagttcagcggcccgctaagaacgggacagtgatggatgtcatcagccgcagagaccagcggggctccggacaggtgggcacctacgggctgaatacgtttaccaacatggaagcccaactgattcgccagatggagagcgagggaatcttctctccttccgaactcgagacacccaacctggctgaaagagtgcttgattggctggagaaacatggcgttgaacggctcaagagaatggccatcagcggggacgactgtgtggtcaaaccgattgatgaccgctttgcgaccgccctgacagctcttaatgatatgggaaaggtgcggaaggacatccctcagtgggagccctctaaaggctggaacgattggcagcaagttcctttctgctcccaccactttcatcagctgattatgaaggacgggagagagatcgtggtcccctgtcgcaatcaggatgaactcgtgggccgggccagagtcagccagggagctggctggtccctgcgcgagaccgcctgcctggggaaatcttatgctcaaatgtggcagctcatgtacttccaccggagagacctgcgccttgccgcgaacgccatttgtagcgctgtgcctgttgattgggtgcccacgtcccggacaacctggagcatccatgcccaccatcagtggatgacaaccgaagacatgctgtctgtctggaatagagtgtggattgaggaaaacccgtggatggaggataagacgcacatctccagctggggagacgttccttatctcggcaaacgcgaggaccaatggtgcgggtctctgatcggacttaccgcccgggctacatgggccaccaatattcaggtggcgatcaaccaggtcagacggctgattggcaatgaaaactacctcgattacatgacaagcatgaagagatttaagaatgagtccgaccccgaaggggctctgtggtga

SEQ ID NO: 18551 - RNA, 9879 nt, synthetic construct
  misc_feature 1..9879: note = derived and/or modified CDS sequence (opt5) from DENV-1__FJ639676__SS-prME
  source 1..9879: mol_type = other RNA
agcgtgaccatgctgctcatgctgatgcccacggcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccgcgcatcacagaggtggaacccgacgatgtggactgttggtgcaataccacggatacctgggtcacatatggaacctgttcccaaacaggcgagcacagacgggacaagcgctctgtggctctggcccctcatgccgggctgggactcgagaccagagctgaaacgtggatgagctccgagggcgcctggaaacagattcagcgggttgaaacatgggctctgcgccaccccggcttcaccgtgatcgccctttttctggcgcatgtcattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaagacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctacctctgagatccagctcacagactacggcgccctgaccctggattgtagcccccggacaggcctcgacttcaacgaaatggtcctgcttaccatgaaggagaaaagctggctggtgcataagcagtggtttctcgatctgcctcttccctggacgtccggggcctctacaagccaagagacctggaatcgccaggacctgctcgtcacattcaaaaccgctcacgcgaagaagcaggaagtggttgtgctgggatcccaagagggcgccatgcacaccgctctgacaggggccacggaaattcagaccagcggaacaaccacaatctttgccggccatctcaaatgcagactgaagatggataaacttaccctgaaggggatgtcttatgtcatgtgtacgggctccttcaaactcgagaaggaagtggctgagacacagcacggaaccgttctggtgcagattaagtacgagggcaccgacgccccgtgcaaaatccctttcagcacacaagatgaaaagggggtcacccagaacggacggctgatcacagcgaatcccattgtgacggacaaagagaagcctgtgaacatcgaagctgagccgccctttggcgagtcttatattgttatcggggccggagaaaaagcccttaagctcagctggttcaagaaaggctcctctattgggaagatgtttgaggctaccgccagaggcgctcgccggatggccatcctgggagatacagcgtgggacttcggcagcatcgggggagtctttacctccgtgggcaaactggtgcatcagattttcgggacagcctacggagtcctctttagcggcgtgtcttggaccatgaagatcgggattggcgttctgcttacgtggctgggactcaattccagaagcacctctctgtccatgacatgtatcgctgtgggcctggtcaccctttacctcggggtgatggttcaggccgatagcggatgcgtgattaactggaaaggccgcgaactgaagtgtgggtccggaatcttcgtcacaaatgaggtgcacacctggacagaacaatataagtttcaggctgactctcctaaacggctgagcgccgcgattggcaaggcctgggaggagggggtttgcggcatcagatccgctacccgcctcgaaaacatcatgtggcggcagatttctaacgagctgaatcatatccttctggaaaacgacatgaaattcacggtggtcgtgggagatgtggtcggcattctcgcccaggggaagaaaatgatcagaccgcaacccatggagcacaagtacagctggaaatcctggggaaaggctaagattatcggcgccgacgttcagaatacaacctttatcattgatgggcctaacacccccgaatgtcctgacgatcagcgcgcctggaatatctgggaggtggaggactatggattcggcatttttacaaccaacatctggctgaaactgcgggatagctacacacaggtgtgcgaccacagacttatgtctgctgcgattaaggattccaaagccgtccatgctgacatgggctattggatcgaaagcgagaagaatgaaacatggaaactcgcccgcgcctctttcatcgaggtgaagacctgtatttggcccaagtcccacacactgtggagcaacggggttctggaatctgagatgatcattccgaaaatctacggaggccctattagccaacataattatcggcccgggtacttcacccagacagctggaccttggcacctcggcaagctggagcttgattttgacctgtgcgaagggaccacggtggtcgtggatgagcactgcggaaacagaggcccctccctccggaccacaaccgttacaggcaaaatcatccatgaatggtgttgccgcagctgtaccctgcctcccctgagattcaagggggaggacggatgctggtacggcatggagattcggccggtgaaagaaaaggaggaaaatcttgtcaagtctatggtgtccgccgggagcggagaggttgactccttttctctcggcctgctgtgtatcagcattatgatcgaagaggtgatgagatcccgctggtctcggaaaatgctcatgacggggacactggcggtcttctttcttctgattgtgggacagctcacctggaacgatctgatcagactgtgcattatggtgggcgctaatgccagcgaccgcatgggcatggggacaacctatcttgccctgatggctaccttcaagatgagacctatgtttgccgtcggactcctgttccggcgcctcacatccagagaggttctgcttctgacgatcggcctctctctggtggcgagcgtggaactgcccaactcccttgaggaactgggggatggactcgctatgggcatcatgattctgaaactcctgaccgactttcaaagctaccagctttgggccacactgctctctctgaccttcatcaagacaaccttttccctgcactatgcctggaaaacgatggctatggtccttagcattgtgtctctgctccccctgtgtctctccacaaccagccagaagaccacatggctgcctgttcttctggggtctctgggatgcaagccgctcaccatgttctttatcgccgagaataaaatttggggccggaagtcctggcccctgaacgaaggcatcatggctgtggggatcgtcagcattcttctgtccagcctcctgaaaaacgatgtgcctctcgccggacccctgatcgcgggcgggatgcttattgcctgttacgttatctctggaagctccgctgacctgtctctggagaaggccgctgaggtgagctgggaagaggaagccgagcattccggcgcctctcacaatattctcgtcgaagtgcaggatgacgggacaatgaaaatcaaggatgaggagcgcgacgatacgctgaccatccttctgaaagctacactcctggcggtcagcggagtgtatcctctctccattcccgccaccctgttcgtttggtacttctggcaaaagaagaaacagagatctggcgtgctttgggacacaccttcccctcccgaagtcgagcgggctgtgctggatgacggcatctatcgcattatgcagagagggctgctcggacggtcccaggttggcgtgggggtctttcaagaaaacgtgttccataccatgtggcacgtgacgcgcggagccgttctgatgtaccagggcaagagacttgagcccagctgggcctctgtcaaaaaggacctgatctcctacgggggaggctggcggctccagggcagctggaataccggggaggaagtccaggtgattgctgtcgagcccggcaagaatcctaagaatgtgcaaacagcccccggcacctttaagacaccggaaggggaggttggagcgatcgctctggatttcaaacctggcacctctgggtcccccattgtgaacagagaaggaaagatcgtcggcctctatggcaatggggtggttacaacgagcggaacctacgtgtccgccatcgcccaggctaaagcctctcaggagggccctctgcccgagattgaagacgaggtctttcgcaagcggaaccttacaatcatggatctgcaccccgggagcggaaaaaccagacgctatctgcctgcgattgtgcgggaagctatcaagagaaagctccgcaccctgattcttgccccgacacgggttgtggcctccgagatggctgaagccctgaaaggcatgcccatcagataccaaacgaccgctgtcaagagcgagcatacagggcgcgagatcgtggacctcatgtgccacgccaccttcacaatgcggctgctgtctcctgtgagagtccccaattataacatgattatcatggatgaagcgcattttaccgacccttccagcattgccgctcggggctacatctctacgcgcgttggaatgggcgaggccgctgccattttcatgacagccacaccccctgggagcgtggaggcttttccgcagtccaatgcggtgatccaggatgaggaaagagacatccccgagcggtcttggaacagcggatatgagtggattaccgatttccctggcaaaacagtctggtttgtgccctccatcaagtctgggaatgacattgccaactgtctccgcaaaaatggaaagagagttatccagcttagccggaagaccttcgatacagaataccagaaaaccaagaacaacgactgggactacgtggtcacgacagatatttccgagatgggcgctaatttcagagccgaccgcgtgatcgatcctcggagatgcctgaaacccgttattctgaaggacgggccggaacgcgtgatcctcgccggccctatgcccgtcaccgtggctagcgccgcgcagcggagaggacgcatcggccggaaccacaataaagagggggatcagtatatttacatgggacagcccctgaacaatgacgaggatcatgctcactggacagaagccaagatgcttctggacaacatcaatacccctgagggcattatccccgccctctttgaacctgagagagaaaagtctgctgccattgatggggagtatcgcctgagaggagaggcgcggaaaacgttcgtcgaactgatgcgcagaggcgacctcccggtgtggctttcctacaaggttgccagcgaggggtttcaatattccgatcggcgctggtgcttcgacggcgaaagaaacaatcaggtgctggaggaaaacatggatgtggagatctggaccaaagagggagaacggaagaaactgagaccccgctggctcgacgctcggacatactctgaccctctggcccttagagagtttaaggagttcgctgccggccgccggagcatctccggggatctgattctcgagatcggaaaactgccccagcacctgacccagagagctcaaaatgccctcgacaaccttgtcatgctgcataattctgaacagggcgggcgggcgtatcgccacgccatggaggagctgcctgatacaattgaaaccctcatgctgcttgctctgatcgccgttctcacaggaggcgtgaccctgtttttcctgagcggcagagggctcggaaagacgtccattggccttctgtgtgtgatggctagctctgccctgctctggatggcctccgtcgagccccattggatcgctgcgagcatcattctggaatttttccttatggtgctgctcatcccggagcctgaccggcagcgcacaccccaggataaccaactggcctacgttgtgattgggctgctctttatgatccttaccgtcgctgccaatgagatgggactgctggaaaccacaaagaaagacctcggcattgggcacgtggccgtcgagaaccaccatcacgctaccatgctggatgtggaccttcatcctgcctctgcgtggacactgtacgccgttgctacgaccatcattacacccatgatgagacacaccatcgaaaacacaaccgccaatatctccctcacggctattgccaaccaggcggccatcctgatgggactggataagggctggcctattagcaaaatggacatcggcgtgcccctccttgctctggggtgctattctcaggtcaatccgctgaccctcacagccgctgtgctgatgcttgttgcccattacgctattatcggacctggcctgcaagccaaggcgacccgggaggcccagaaacgcacagctgccgggatcatgaagaaccccaccgtggatggaattgtcgctatcgacctcgatcccgtggtgtatgacgccaagttcgaaaaacagctgggccagattatgctgctcatcctttgtacgagccaaattctgctgatgagaacaacctgggccctctgcgagtccatcacactggcgaccgggcctcttaccacactgtgggagggatctccgggcaagttttggaatacgaccatcgctgttagcatggccaacattttccggggctcctacctcgctggggccggactggccttcagcctgatgaaatccctcggcgggggacgcagaggcacaggggctcagggagaaacccttggcgagaagtggaaacggcagctgaatcagctgtctaagagcgaatttaacacatataagagatccggcatcctcgaggtcgaccgctctgaagccaaagaggggctgcggagaggagagaccacgaagcacgcggtgagccgcggcacagccaaacttcggtggttcgtggaaagaaatctggtcaagcccgaggggaaagttattgatctcggatgtggccgcgggggatggtcctactattgcgctggcctgaagaaggtgaccgaagtgaaaggctacaccaaagggggacctggccacgaggaacccatccctatggccacatacgggtggaacctggtcaaactccattctggaaaggacgtgtttttcattccccctgagaaatgtgatacccttctgtgcgacatcggcgagagctccccgaatcccacaattgaagaggggcggacgctgagagttctcaagatggtggaaccttggctgcgcggaaaccaattttgtatcaaaatccttaatccctatatgcctagcgtcgtggagaccctggagcagatgcagcggaagcacggcggcatgctcgttagaaaccccctgtctcgcaattccacacatgaaatgtactgggtgagctgcgggaccggaaacattgtctctgctgtgaatatgacatcccggatgctgctcaacagattcaccatggcccaccgcaagccgacgtatgagagagatgtggacctgggcgcggggacccggcacgtcgccgttgaacctgaggtggctaaccttgatatcattggacagcgcatcgaaaatattaaacatgagcacaagagcacatggcattacgacgaggataacccctataaaacctgggcctaccacggctcttatgaagtgaagccctccgggagcgcttccagcatggtcaatggagtggttaaactgctcacaaagccttgggacgtgatccccatggtcacccaaatcgccatgacagataccacgccttttggccagcagagagtgttcaaggagaaagttgacacacggaccccgaaggctaaaagaggcaccgcccaaattatggaagtgacagcgcggtggctgtgggggtttctttctcgcaacaagaaacccagaatctgtacgcgggaggagttcacccgcaaggtcagaagcaatgccgctattggagccgtgtttgttgacgagaaccagtggaactccgctaaggaggccgtggaagatgagcggttctgggacctggtccatcgcgaaagagagctccacaaacagggcaagtgcgccacatgcgtgtacaacatgatggggaaacgggaaaagaaactgggagagtttggcaaggcgaaggggtctcgcgctatctggtacatgtggctgggcgccagattcctcgagttcgaagccctgggatttatgaatgaggatcactggttcagccgggaaaactccctttctggcgtcgagggggagggactgcataaactcggctatattctgcgcgacatcagcaagatccctgggggaaatatgtacgctgatgacaccgccggctgggatacaagaattaccgaagacgatcttcagaacgaggctaaaatcacagacattatggaacccgagcacgccctgctcgcgacctccatctttaagctgacgtatcaaaataaagtggttcgggtgcagcgccctgccaagaacgggaccgtcatggatgtgatttctagacgggaccagagaggcagcggacaggtgggcacatacgggctgaataccttcacaaacatggaagctcaactcatccgccagatggagtccgagggaatctttagcccctctgaactggagaccccgaaccttgccgaacgggttctggattggctcgagaaatatggcgtggaaagactgaagcgcatggctatttccggggacgactgtgtcgtgaagcctatcgatgaccggttcgccacggcgcttacagccctgaatgatatgggaaaagttagaaaggacattccccagtgggagcctagcaaaggctggaacgattggcagcaagtgcccttttgctctcatcacttccaccagctcatcatgaaggacgggcgcgagattgtcgtgccttgtcggaatcaggatgaactggtcggcagagctcgcgtgtcccagggagccggctggagcctgcgggagaccgcttgcctcgggaaatcctacgcccaaatgtggcagctgatgtattttcatagacgcgaccttcggctggctgccaacgcgatctgttctgccgttcccgtggattgggtcccgacaagcagaaccacgtggtccattcacgctcatcaccagtggatgaccacagaagacatgctcagcgtgtggaatcgggtttggatcgaggaaaacccttggatggaggataagacccatatctcttcctgggaggacgtgccctacctgggaaagagagaagaccaatggtgcggcagccttattgggctgacagcccgcgccacctgggctacaaatatccaggtcgccattaaccaggtgcggagactcatcggaaatgagaactacctggatttcatgacctctatgaaacgctttaagaatgaaagcgacacggagggcgcgctgtggtga

SEQ ID NO: 18552 - RNA, 9879 nt, synthetic construct
  misc_feature 1..9879: note = derived and/or modified CDS sequence (opt5) from DENV-1__FJ639677__SS-prME
  source 1..9879: mol_type = other RNA
agcgtgaccatgctgctcatgctgatgcccaccgcccttgctttccacctgacgacccggggcggggaacctcatatgatcgtgtccaagcaggaacggggaaagtctctcctgtttaagaccagcgccggcgttaacatgtgcacccttatcgcgatggacctgggggaactctgtgaagatacaatgacctacaagtgcccccgcgtgacagaggctgaacccgacgatgtggactgttggtgcaatgccaccgatacgtgggttacctatggaacatgttcccaaaccggcgagcaccggcgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccgtgctgcgcaaactttgcatcgaagcgaagatttccaataccacgacagatagcagatgtccgacccaaggagaggccaccctggtggaagaacaggacgctaacttcgtctgccggcgcacatttgtggatagaggctggggcaatgggtgtggactcttcggcaaagggtctctgattacctgcgccaagtttaagtgcgttacaaaacttgagggaaagattgtgcagtacgaaaacctgaaatattccgtcatcgtgacggttcacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggtcctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggttgtgctgggaagccaagagggcgctatgcacacagccctgacgggggccaccgaaatccagacatccggaaccacaaccatttttgctggccatctcaaatgcagactgaagatggataaacttacgctgaaggggatgagctatgtcatgtgtacaggctctttcaaactcgagaaggaagtggccgagacccagcacggaaccgttctggtgcagatcaagtacgagggcacagacgcgccgtgcaaaattcctttctccacccaagatgaaaagggggtcacacagaacggacggctgatcacggctaatcccatcgtgaccgacaaagagaagcctgtgaacattgaagccgagccgccctttggcgagagctatatcgttattggggccggagaaaaagctcttaagctctcttggttcaagaaaggcagctccatcgggaagatgtttgaggccacagctagaggcgcccgccggatggcgattctgggagataccgcctgggacttcggctctatcgggggagtctttacaagcgtgggcaaactggtgcatcagatcttcgggaccgcttacggagtcctcttttccggcgtgagctggacgatgaagattgggatcggcgttctgcttacctggctgggactcaattctagatccacaagcctgtctatgacctgtattgccgtgggcctggtcacactttacctcggggtgatggttcaggctgattccggatgcgtgatcaactggaaaggccgcgaactgaagtgtgggagcggaattttcgtcaccaatgaggtgcacacatggaccgaacaatataagtttcaggccgactcccctaaacggctgtctgcggccatcggcaaggcttgggaggagggggtttgcggcattagaagcgccacgcgcctcgaaaacatcatgtggaaacagatctccaacgagctgaatcatattcttctggaaaacgacatgaagctcacagtggtcgtgggagatgtggctggcatcctggcccaggggaaaaagatgattcggccgcaacccatggagtacaaatattcttggaaaagctggggaaaggccaagatcattggcgctgacgcgcagaataccaccttcatcatcgatgggcctaacacacccgaatgtcctgacgatcagagagcctggaatatttgggaggtcgaggactacggatttggcatcttcaccacgaacatttggctgaaacttcgcgattcctatacacaggtttgcgaccaccggctcatgagcgctgccatcaaagattctaaggccgtgcacgctgacatgggctactggattgaatccgagaaaaatgaaacctggaagctggccagagcgagctttatcgaggtgaagacatgtatctggcccaaatctcataccctgtggtccaacggggtcctcgaaagcgagatgattatcccgaagatttatggaggccctatctctcaacacaattaccgccccgggtacttcacacagaccgctggaccttggcatctgggcaaacttgagctggatttcgacctctgcgaagggacgaccgtggttgtggatgagcactgcggaaaccggggccccagcctgagaacaaccacagtcaccggcaagattatccacgaatggtgttgccggtcctgtacgctgcctccccttcgctttagaggggaggacggatgctggtatggcatggagatccggccggtgaaagaaaaggaggaaaatctcgttaagagcatggtgtctgccgggtccggagaggtcgacagcttctccctgggcctgctctgtatttctatcatgattgaagaggtgatgagaagccgctggtcccggaaaatgctgatgacagggacccttgccgtctttttcctgctcatcatgggacagctgacatggaacgatctgattagactttgcatcatggtgggcgctaatgcctctgaccgcatgggcatggggaccacctacctggcgctcatggctacatttaagatgagacctatgttcgccatgggactgctctttcggcgcctgacgagcagagaggtccttctgctcaccattggcctgtccctggtggcctctgtggaacttcccaacagcctggaggaactcggggatggactggctatgggcatcatgatcctcaaactgcttacagacttccaatcccatcagctgtgggccaccctcctgagcctgacatttattaagaccacgttctctcttcactatgcttggaaaacaatggccatggtcctgtccatcgttagcctctttcccctgtgtctctctaccacctcccagaagacaacctggctgcctgtgcttctggggagcctgggatgcaagccgctcacaatgttcctgattgcggagaataaaatctggggccggaagtcttggccccttaacgaaggcattatggccgtggggatcgtctccatcctgctcagctccctgctcaaaaacgatgtgcctctggctggaccccttattgccggcgggatgctgatcgcttgttacgttattagcggatctagcgccgacctgtccctcgagaaggccgctgaggtgtcttgggaagaggaagcggagcatagcggcgcctcccacaatatcctggtcgaagtgcaggatgacgggacgatgaaaattaaggatgaggagcgcgacgatacccttacaatcctgctcaaagctaccctgctcgccgtttctggagtgtatcctctgagcatccccgccacactttttgtctggtacttctggcaaaagaagaaacagagatccggcgtgctgtgggacaccccttctcccccggaagtcgagcgggctgtgctggatgacggcatttatcgcatcatgcagagagggctcctgggacggagccaggttggcgtgggggtcttccaagaaaacgtgtttcatacgatgtggcacgttacccgcggagccgtgcttatgtaccagggcaagagactggagccttcctgggcgagcgtcaaaaaggacctcatttcttacgggggaggctggcggctgaaaggctcctggaatacaggggaggaagtccaggtgatcgctgttgagcccggaaagaaccctaagaatgtccagaccgcccccggcacattcaaaaccccggaaggggaggtgggagccattgctctcgattttaagcctggcacaagcgggtctcccatcgtgaacagagaaggaaaaattgtcggcctgtatggcaatggggtggttacgacctccggaacatacgtgagcgccatcgcgcaagctaaggcctcccaggagggccctcttcccgagatcgaagacgaggtcttccgcaaacggaacctgaccattatggatctgcaccccgggtctggaaagaccagacgctatctccctgccatcgtgcgggaagctattaagagaaaactgcgcacacttatcctggccccgacgcgggttgtggctagcgagatggccgaagcgctcaagggcatgcccattagataccagaccacagccgtcaaatccgagcataccgggaaggagatcgtggacctgatgtgccacgctacatttaccatgcgcctgctcagccctgttcgggtgcccaattataacatgatcattatggatgaagcccatttcacggacccttcttccatcgctgccagaggctacattagcacacgggtcggaatgggcgaggccgctgcgatctttatgaccgccacaccccctgggtctgtggaggctttcccgcaaagcaatgccgtgattcaggatgaggaacgcgacatccccgagagatcctggaactctggatatgagtggatcacagattttcctggcaaaaccgtctggttcgttcccagcattaagtccgggaatgacatcgccaactgtcttcggaagaatggaaaacgcgtgattcagctgtctagaaagacatttgataccgaataccagaaaacgaagaacaacgactgggactacgtggtcacaaccgatatcagcgagatgggcgctaatttccgggccgacagagtgattgatcctcgccggtgcctgaaacccgttatcctcaaggacgggccggaaagagtgattctggcgggccctatgcccgtcacagtggcttccgccgcccaacgccggggaagaatcggccgcaaccacaataaggagggggatcagtatatctacatgggacagccccttaacaatgacgaggatcatgctcactggaccgaagccaaaatgctgctcgacaacattaatacgcctgagggcatcattcccgcgctgttcgaacctgagcgggaaaagagcgccgctatcgatggggagtatagactgcgcggagaggccagaaaaacctttgttgaactcatgcggcgcggcgaccttccggtgtggctgtcttacaaggtcgcttccgaggggttccagtatagcgatagacggtggtgctttgacggcgaacgcaacaatcaagtgctggaggaaaacatggatgtcgagatttggacaaaagagggagaaagaaagaaactccggcccagatggctggacgcccgcacctactccgaccctcttgctctgcgggagttcaaggaatttgccgcgggcagacgctctgtgagcggggatctcatcctggagatcggaaagctgccccagcacctcacacagcgggcccagaatgctcttgacaacctggttatgctgcataattccgaacaaggcgggagagcctatcggcacgctatggaggagctccctgataccattgaaacactgatgcttctggccctcatcgccgtgctgaccggaggcgtgacgctgttctttctctctggccgcgggcttggaaaaacaagcattggcctgctgtgtgtcatggcttccagcgttctcctgtggatggcgtctgtggagccccattggatcgccgcttccattatccttgagttctttctgatggtgctcctgatcccggagcctgacagacagcggacaccccaggataaccagctggcctacgtcgtgattgggctccttttcatgatcctgaccgttgccgctaatgagatgggactgctcgaaacaaccaagaaagacctgggcattgggcacgtggccgtcgagaaccaccatcacgcggccatgcttgatgtggacctgcatcctgctagcgcctggacactctacgctgtcgccacgaccatcattacacccatgatgcgccacaccatcgaaaacacaaccgcgaatatttctctgacggccatcgctaaccaagccgctatcctgatgggactcgataagggctggcctatttccaaaatggacatcggcgtgccccttctggccctggggtgctatagccaggttaatccgctcaccctgacagctgccgtgcttatgctggtcgcgcattacgccattatcggacctggcctccaggctaaggccaccagagaggctcaaaagcggacagccgccgggattatgaaaaaccccaccgtggatggaatcgttgcgatcgacctggatcccgtggtctatgacgctaagtttgaaaaacagctgggccagattatgctccttatcctgtgtacgtctcagattctgctcatgcgcacaacctgggccctgtgcgagagcatcacacttgctaccgggcctctgaccacactctgggagggatccccgggcaagttctggaatacgaccattgccgtgtctatggccaacatctttagaggcagctacctggctggggccggactggcgttctccctcatgaaaagccttggcgggggacggcgcggcacaggggcccaaggagaaaccctgggcgagaagtggaagagacagctgaatcagctctccaaatctgagttcaacacatataagcggagcggcatcatggaggtggacagatccgaagctaaagaggggctgaagcgcggagagaccacgaaacacgccgtttctcggggcacagctaaacttagatggtttgtcgaacgcaatctggtgaagcccgaggggaaagtgattgatctcggatgtggcagaggcgggtggagctactattgcgccgggctgaagaaagtcaccgaagttaagggctacaccaaagggggacctggccacgaggaacccatccctatggcgacatacgggtggaacctggtgaagctccattccggaaaagacgtgttctttattccccctgagaagtgtgatacccttctgtgcgacatcggcgagtctagcccgaatcccacaattgaagaggggagaacgctgcgcgtcctcaagatggtggaaccttggctgcggggaaaccagttctgtatcaaaattcttaatccctatatgccttccgttgtggagaccctggagcaaatgcagagaaagcacggcggcatgctcgtccgcaaccccctgagcagaaattctacacatgaaatgtactgggtgtcctgcgggaccggaaacatcgttagcgccgtgaatatgacatctagaatgctgctcaaccgctttaccatggctcaccggaaaccgacgtatgagagagatgtcgacctgggcaccgggacacgccacgtggccgtggaacctgaggtcgctaaccttgatatcattggacagagaatcgaaaatattaagcatgagcacaaatccacctggcattacgacgaggataacccctataagacatgggcctaccacggcagctatgaagttaagccctctgggtccgctagctccatggtgaatggagtggtcaaactgctcaccaagccttgggacgtgatccccatggttacacagattgccatgaccgatacgacacctttcggccaacagcgggtgtttaaagagaaggtcgacacccgcaccccgaaagcgaagagaggcacagcccagatcatggaagtgacggctcggtggctgtgggggttccttagcagatctaagaaaccccggatctgtacccgcgaggaatttattagaaaggttcggagcaacgccgctatcggagccgtgttcgtcgacgagaatcaatggaactccgccaaagaggcggtggaagatgagcgcttttgggacctggttcatagagaacgggagctccacaagcagggcaaatgcgctacatgcgtgtacaatatgatggggaagcgcgaaaagaaactgggagagttcggcaaggccaaagggtctagagccatttggtacatgtggctgggcgctcggtttctcgagttcgaagccctgggattcatgaacgaggatcactggtttagccgcgaaaattccctttctggcgtcgagggggagggactgcataagctcggctatatcctgagagacattagcaaaatccctgggggaaacatgtacgctgatgacaccgccggctgggatacacggatcaccgaagacgatcttcagaatgaggcgaagattacagacatcatggaacccgagcacgccctgctcgctaaagccattttcaagctgacctatcagaacaaggtggtccgcgtgcaaagacctgctaaaaatgggacggttatggatgtgatctcccggcgcgaccagagaggctctggacaggtcggcacctacgggctgaacacatttaccaatatggaagcccagctcattcggcaaatggagagcgagggaatcttctcccccagcgaactggagacaccgaaccttgcggaaagagccctggattggctcgagaagtatggcgtggaacgcctgaaacggatggctatctctggggacgactgtgtggttaagcctattgatgacagatttgccaccgctcttacggccctgaacgatatgggaaaagtgcgcaaggacatcccccagtgggagccttccaagggctggaatgattggcagcaggtccccttctgcagccatcactttcaccaactcattatgaaagacgggcgggagatcgtggttccttgtagaaaccaggatgaactggtgggccgcgctcgggtctctcagggagccggctggtccctgagagagacagcgtgcctcggaaagagctacgcccagatgtggcaactgatgtatttccatcgccgggaccttagactggctgccaatgccatttgttccgctgtgcccgtcgattgggtgccgacctctcgcacaacctggagcatccacgcccatcaccagtggatgacgaccgaagacatgctctccgtttggaaccgggtgtggattgaggaaaatccttggatggaggataaaacacatatcagctcttgggaggacgtcccctacctgggaaagagagaagaccagtggtgcggctcccttatcgggctgaccgcgcgggctacatgggccaccaacattcaagtggccatcaatcaggttagacgcctcattggaaacgagaattacctggattatatgacaagcatgaaacggtttaagaacgaatctgaccccgagggcgctctgtggtga

SEQ ID NO: 18553 - RNA, 9879 nt, synthetic construct
  misc_feature 1..9879: note = derived and/or modified CDS sequence (opt5) from DENV-1__GQ868618__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagtttacggttgtggtcggagatgtggctggcattctggcccaggggaaaaagatgatccggccgcaacccatggagtacaaatatagctggaagtcctggggaaaggccaaaattatcggcgctgacgtgcagaatacaaccttcatcattgatgggcctaacacccccgaatgtcctgacgatcagagagcgtggaatatctgggaggtcgaggactacggatttggcattttcacaaccaacatctggctcaagctgcgcgatagctatacgcaggtttgcgaccaccggctgatgtctgccgctattaaagattccaaggccgtgcacgccgacatgggctactggatcgaaagcgagaaaaatgaaacatggaaacttgctagagcctctttcatcgaggtgaagacctgtatttggcccaaatcccatacactctggagcaacggggtcctggaatctgagatgatcattccgaagatctatggaggccctattagccaacacaattaccgccccgggtactttacccagacagcgggaccttggcatctgggcaaactcgagctggatttcgacctttgcgaagggaccacggtggttgtggatgagcactgcggaaaccggggcccctccctgagaaccacaaccgtcacaggcaagatcatccacgaatggtgttgccggagctgtaccctccctcccctgcgctttaaaggggaggacggatgctggtatggcatggagattagaccggtgaaggaaaaggaggaaaatctggttaaatctatggtgtccgctgggagcggagaggtcgactccttctctcttggcctcctgtgtatcagcattatgatcgaagaggtgatgcggtccagatggtctcgcaagatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaaaatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaagctgctcaccgacttccaaagccatcagctgtgggctacacttctgtctctcacctttatcaaaacaaccttctccctgcactatgcctggaagacgatggctatggttctgagcattgtgtctctttttcccctgtgtctctccacaaccagccagaagaccacatggctgcctgtgctcctggggtctcttggatgcaaaccgctgaccatgttcctgatcgccgagaataagatttggggcagaaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggacaatgaagatcaaagatgaggagcgggacgatacgctcaccatcctgcttaaggccacactgctcgctgtgagcggagtctatcctctgtccattcccgccaccctcttcgtgtggtacttttggcaaaagaaaaagcagcgctctggcgtcctgtgggacacaccttcccctcccgaagtggagagagccgttcttgatgacggcatctatcggattatgcagcgcgggctgctgggaagatcccaggtgggcgtcggggtgttccaagaaaacgtttttcataccatgtggcacgtgacgcggggagctgtcctcatgtaccagggcaaacgcctggagcccagctgggcctctgtgaagaaagaccttatctcctacgggggaggctggagactgcagggcagctggaataccggggaggaagtgcaggttattgcggtcgagcccggaaagaaccctaagaatgtgcaaacagctcccggcaccttcaaaacatctgaaggggaggtgggagccatcgccctcgattttaagccgggcacctccgggagccctattgtcaaccgggaaggaaaaatcgtgggcctgtatggcaatggggttgtgacaacgtccggaacctacgtctctgctatcgcccaggcgaaggctagccaggagggccccctccctgagattgaagacgaggtgttcagaaaacgcaacctgacaatcatggatcttcaccccgggtccggaaagacccggagatatctgcccgccattgttcgcgaagccatcaagcggaaactgagaaccctcattctggctcctacacgcgtggtcgccagcgagatggctgaagcccttaagggcatgccgatccggtaccaaacgaccgcggtgaaatctgagcatacagggaaggagatcgttgacctgatgtgccacgccacctttacaatgagactcctgtcccccgtgcgcgtccctaattataacatgattatcatggatgaagctcatttcaccgaccccagctctattgccgctcggggctacatcagcacgagagtgggaatgggcgaggccgccgctatttttatgacagcgacccctcccgggtccgtggaagccttccctcagtctaatgctgtcatccaggatgaggaacgggacatcccggagcgcagctggaactccggatatgagtggattaccgattttcccggcaaaacagtttggttcgtgccttctatcaagagcgggaatgacattgccaactgtctgagaaagaatggaaaacgggtgatccagctctcccgcaagaccttcgatacagaataccagaagaccaagaacaacgactgggactacgtcgtgacgacagatattagcgagatgggcgccaattttagagctgaccgggttatcgatcccagacgctgccttaaacctgtgattctgaaggacgggcccgaacgggtcatcctggccggcccgatgcctgtgaccgttgcgtctgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagtccgcggccattgatggggagtatcggctcagaggagaggctcgcaaaacgtttgtggaactgatgagacggggcgacctgcctgtctggctcagctacaaggtggcctccgaggggttccaatattctgatcgcagatggtgctttgacggcgaacggaacaatcaggtccttgaggaaaacatggatgtggagatctggaccaaagagggagaacgcaagaaactgagaccgcggtggctggacgctagaacatacagcgaccccctcgccctgcgcgagttcaaggaatttgctgccggccggagatccgtttctggggatcttatcctggagattggaaagctccctcagcacctgacccagcgcgcgcaaaatgccctggacaacctcgtgatgcttcataatagcgaacagggcgggcgggcttatagacacgccatggaggagctgcccgatacaatcgaaaccctgatgctcctggctcttattgccgtgctgacaggaggcgtcaccctcttctttctgtccggccgggggctgggaaaaacgagcatcggcctcctttgtgttatggcctcttccgtgctgctgtggatggctagcgtggagcctcattggattgcggcctctatcatcctcgagttctttctgatggtccttctgattcccgagccggaccgccagagaacacctcaggataaccaactcgcttacgtggttatcgggctgctgttcatgattctcaccgtggccgccaatgagatgggacttctggaaaccacaaagaaagacctgggcatcgggcacgtcgctgtggagaaccaccatcacgccgcgatgctcgatgtcgacctgcatcccgcctccgcttggaccctttacgccgtggctacaacgattatcacccctatgatgcggcacacaattgaaaacaccacagccaatatcagcctgaccgcgatcgccaaccaggctgccattctcatgggactggataagggctggcccatctctaaaatggacattggcgttcctctgctcgctcttgggtgctatagccaggtgaatcccctgacgctgaccgccgctgtcctcatgctggtggcccattacgcgatcattggaccgggccttcaagccaaggctacacgcgaggcccagaagagaaccgctgccgggatcatgaaaaaccctacagttgatggaatcgtggccattgacctggatcccgtcgtgtatgacgcgaagtttgaaaaacagctcggccagatcatgctgctgattctctgtacctcccaaatccttctgatgcggacgacatgggctctgtgcgagtctattaccctcgccacagggcccctgaccaccctttgggagggaagccctggcaagttctggaatacaacgatcgctgtgtccatggccaacatcttccgcggcagctacctggccggggctggactcgccttttccctgatgaaatctctgggcgggggaagacggggcaccggggcgcagggagaaacactcggcgagaagtggaagcgccagcttaatcagctgagcaaatccgagttcaacacctataagagatctggcattatggaggttgaccggagcgaagccaaagaggggctgaagagaggagagacaaccaaacacgctgtctcccgcggcacggccaagctccggtggtttgtggaaagaaatctggtgaagccggaggggaaagtcatcgatcttggatgtggccgcgggggatggtcttactattgcgctggcctgaagaaagttacagaagtgaagggctacaccaaagggggacccggccacgaggaacctattcccatggccacctacgggtggaacctcgtgaagctgcatagcggaaaagacgtcttctttatccctcccgagaagtgtgatacactgctctgcgacattggcgagtccagccctaatccgaccatcgaagaggggcggacacttagagtgctgaagatggttgaaccctggctgcgcggaaaccaattctgtattaaaatcctcaatccttatatgccctctgtggtcgagacgctggagcagatgcagcggaagcacggcggcatgcttgtgagaaaccctctgtcccgcaatagcacccatgaaatgtactgggtttcttgcgggacaggaaacatcgtgtccgcggtcaatatgaccagccggatgctcctgaacagatttacaatggcccaccgcaaacccacctatgagcgggatgtggacctgggcgctgggacgagacacgtggccgtcgaaccggaggttgctaacctcgatattatcggacagcgcattgaaaatatcaagcatgagcacaaatctacctggcattacgacgaggataacccttataagacatgggcctaccacggctcctatgaagtgaagcccagcgggtccgctagctctatggtgaatggagtcgtgaaactgcttaccaagccctgggacgttattcctatggtgacacaaatcgccatgaccgatacaacccccttcggccagcagagagtctttaaagagaaggtggacacgcggacacctaaagcgaagcgcggcaccgcccaaatcatggaagttaccgctaagtggctgtgggggttcctcagcagaaacaaaaagccgcggatttgtacaagagaggaatttacgcggaaagtgcgctccaatgccgctatcggagccgtcttcgtggacgagaaccagtggaactctgccaaggaggcggttgaagatgagagattttgggacctggtgcatcgggaacgcgagcttcacaaacagggcaagtgcgctacctgcgtctacaacatgatggggaagagagagaagaagctgggagagttcggcaaagccaaggggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaagatccccgggggaaatatgtacgctgatgacacagccggctgggatacccgcatcacagaagacgatctccagaacgaggcgaaaattaccgacatcatggaacctgagcacgccctgcttgctaagtctattttcaagctgacatatcaaaataaagtcgtgagagttcagcggcccgccaagaacgggaccgtgatggatgtcatcagccgcagagaccagcggggctccggacaggtgggcacgtacgggctcaatacctttacaaacatggaagctcaactgattcgccagatggagagcgagggaatcttctctccttccgaactggagacccccaacctcgccgaaagagtgctggattggcttgagaaacatggcgttgaacggctgaagagaatggcgatcagcggggacgactgtgtggtcaaaccgattgatgaccgctttgccacagctctcaccgccctgaatgatatgggaaaggtgcggaaggacatccctcagtgggagccctctaaaggctggaacgattggcagcaagttcctttctgctcccaccactttcatcagcttattatgaaggacgggagagagatcgtggtcccctgtcgcaatcaggatgaactggtgggccgggctagagtcagccagggagccggctggtccctccgcgagacggcttgcctggggaaatcttatgcccaaatgtggcagctgatgtacttccaccggagagacctccgcctggcggccaacgctatttgtagcgccgtgcctgttgattgggtgcccacatcccggaccacatggagcatccatgcccaccatcagtggatgaccacggaagacatgctttctgtctggaatagagtgtggattgaggaaaacccgtggatggaggataagacccacatctccagctggggagacgttccttatctgggcaaacgcgaggaccaatggtgcgggtctctcatcggactgacagctcgggccacctgggcgacaaatattcaggtggctatcaaccaggtcagacggcttattggcaatgaaaactacctggattacatgaccagcatgaagagatttaagaatgagtccgaccccgaaggggccctctggtga

SEQ ID NO: 18554 - RNA, 9879 nt, synthetic construct
  misc_feature 1..9879: note = derived and/or modified CDS sequence (opt5) from DENV-1__GQ868619__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagacaagcgccggcgttaacatgtgcacccttattgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggcccaggggaaaaagatgatccggccgcaacccatggagtacaaatattcttggaaaagctggggaaaggccaagattatcggcgctgacgcgcagaataccaccttcatcattgatgggcctaacacacccgaatgtcctgacgatcagagagcctggaatatctgggaggtggaggactacggatttggcattttcaccacgaacatctggctgaaacttcgcgattcctatacacaggtctgcgaccaccggctcatgagcgctgccattaaagattctaaggccgttcacgctgacatgggctactggatcgaatccgagaaaaatgaaacctggaagctggccagagcgagctttatcgaggtgaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggatttcgacctctgcgaagggacgaccgtcgtggttgatgagcactgcggaaaccggggccccagcctgagaacaaccacagtgaccggcaagatcatccacgaatggtgttgccggtcctgtacgctgcctccccttcgctttagaggggaggacggatgctggtatggcatggagattcggccggtcaaagaaaaggaggaaaatctcgtgaaaagcatggtttctgccgggtccggagaggtggacagcttctccctgggcctgctctgtatctctattatgatcgaagaggtcatgagaagccgctggtcccggaaaatgctgatgacagggacccttgtggtctttttcctgctcattatgggacagctgacatggaacgatctgatcagactttgcattatggtgggcgccaatgcttctgaccgcatgggcatggggaccacctacctggccctcatggcgacatttaagatgagacctatgttcgctgtcggactgctctttcggcgcctgacgagcagagaggtgcttctgctcaccatcggcctgtccctggtggcctctgtcgaacttcccaacagcctggaggaactcggggatggactggccatgggcatcatgattctcaaactgcttacagacttccaatcccatcagctgtgggctaccctcctgagcctgacatttatcaagaccacgttctctcttcactatgcctggaaaacaatggctatggttctgtccattgtgagcctctttcccctgtgtctctctaccacctcccagaagacaacctggctgcctgtgcttctggggagcctgggatgcaagccgctcacaatgttcctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttacgtgatcagcggatctagcgctgacctgtccctcgagaaggccgccgaggtctcttgggaagaggaagctgagcatagcggcgcgtcccacaatattctggtggaagttcaggatgacgggacgatgaaaatcaaggatgaggagcgcgacgatacccttacaatcctgctcaaagccaccctgctcgctgtgtctggagtctatcctctgagcattcccgccacactttttgtgtggtacttctggcaaaagaagaaacagagatccggcgtcctgtgggacaccccttctcccccggaagtggagcgggccgttctggatgacggcatctatcgcattatgcagagagggctcctgggacggagccaggtgggcgtcggggtgttccaagaaaacgtttttcatacgatgtggcacgtgacccgcggagctgtccttatgtaccagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacattcaagaccccggaaggggaggtgggagccatcgccctcgattttaaacctggcacaagcgggtctcccattgtcaacagagaaggaaagatcgtgggcctgtatggcaatggggttgtgacgacctccggaacatacgtcagcgctatcgcccaggcgaaggcttcccaggagggccctcttcccgagattgaagacgaggtgttccgcaagcggaacctgaccatcatggatctgcaccccgggtctggaaaaaccagacgctatctccctgccattgttcgggaagccatcaagagaaagctgcgcacacttattctggctccgacgcgggtggtcgccagcgagatggctgaagccctcaaaggcatgcccatcagataccaaaccacagcggtgaagtccgagcataccgggaaagagatcgttgacctgatgtgccacgccacatttaccatgcgcctgctcagccctgtgcgggtccccaattataacatgattatcatggatgaagctcatttcacggacccttcttccattgccgctagaggctacatcagcacacgggtgggaatgggcgaggccgccgctatttttatgaccgcgacaccccctgggtctatggaagccttcccgcagagcaatgctgtgatccaggatgaggaacgcgacatccccgagagatcctggaactctggatatgagtggattacagattttcctggcaagaccgtctggttcgttcccagcatcaaatccgggaatgacattgccaactgtcttcggaagaatggaaagcgcgtgatccagctgtctagaaaaacatttgataccgaataccaaaagacgaaaaacaacgactgggactacgtggtcacaaccgatattagcgagatgggcgccaatttccgggctgacagagtgatcgatcctcgccggtgcctgaagcccattatcctcaaagacgggccggaaagagttatcctggccggccctatgcccgtgacagtcgcgtccgctgcccagcgccggggaagaattggccgcaaccacaataaggagggggatcagtatatctacatgggacagccccttaacaatgacgaggatcatgcccactggaccgaagctaagatgctgctcgacaacattaatacgcctgagggcatcattcccgccctgttcgaacctgagcgggaaaagagcgcggccatcgatggggagtatagactgcgcggagaggctagaaagacctttgtggagctcatgcggcgcggcgaccttccggtttggctgtcttacaaagtggcctccgaggggttccaatatagcgatagacggtggtgctttgacggcgaacgcaacaatcaggtcctggaggaaaacatggatgtggagatctggacaaaggagggagaacgcaaaaagctccggcccagatggctggacgctcgcacctactccgaccctcttgccctgcgggagttcaaagaatttgctgccggcagacgctctgtcagcggggatctcattctggagatcggaaagctgccccagcacctcacacagcgggcgcaaaatgcccttgacaacctggtgatgctgcataattccgaacagggcgggagagcttatcggcacgccatggaggagctccctgataccattgaaacactgatgcttctggctctcatcgccgttctgaccggaggcgtgatgctgttctttctctctggccgcgggcttggaaagacgagcattggcctgctgtgtgtgatggcctccagcgggctcctgtggatggcttctgtcgagccccattggatcgcggcctccatcattcttgagttctttctgatggttctcctgatcccggagcctgacagacagcggacaccccaggataaccaactggcttacgtggtgatgggactccttttcatgattctgaccgtcgccgccaatgagatgggcctgctcgaaaccaccaaaaaggacctggggatcggacacgtggctgttgagaaccaccatcacgccgcgatgcttgatgtggacctgcatcctgccagcgcttggaccctctacgccgtcgctacaacgattatcacccccatgatgcgccacacaattgaaaacaccacagccaatatctctctgaccgcgatcgccaaccaggctgccattctgatgggcctcgataaaggctggcctatctccaagatggacattggggtgccccttctggctctgggatgctatagccaggtcaatccgctcacgctgaccgccgctgtgcttatgctggttgcccattacgcgatcattggccctgggctccaagccaaagctacaagagaggcccagaagcggaccgctgccggaatcatgaagaaccccacagtggatggcatcgtcgccattgacctggatcccgtggtttatgacgcgaaatttgaaaagcagctggggcagatcatgctccttattctgtgtacctctcaaatcctgctcatgcgcacgacatgggctctgtgcgagagcattacccttgccacaggacctctgaccaccctctgggagggctccccgggcaaattctggaatacaacgatcgctgtgtctatggccaacatctttagagggagctacctggccggagctggcctggccttctccctcatgaaaagccttgggggaggccggcgcgggaccggagcgcagggcgaaacactgggcgagaaatggaagagacagctgaatcagctctccaagtctgagttcaacacctataaacggagcgggattatggaggtcgacagatccgaagccaaggagggactgaaacgcggcgagacaaccaagcacgctgtgtctcgggggacggccaaacttagatggtttgtggaacgcaatctggttaagcccgagggaaaggtcatcgatctcggctgtgggcggggaggctggagctactattgcgctggcctgaaaaaggtgacagaagtgaaagggtacaccaagggaggccctgggcacgaggaacccattcctatggccacctacggatggaacctggtcaaactccattccggcaaggacgttttctttattccccctgagaaatgtgatacacttctgtgcgacatcggggagtctagcccgaatcccaccatcgaagagggaagaacactgcgcgtgctcaagatggtggaaccttggctgcggggcaaccaattctgtattaagatccttaatccctatatgccttccgtcgtggagacgctggagcagatgcagagaaaacacggcgggatgctcgttcgcaaccccctgagcagaaattctacccatgaaatgtactgggtgtcctgcggaacaggcaacatcgtcagcgcggtgaatatgacctctagaatgctgctcaaccgctttacaatggcccaccggaagccgacctatgagagagatgttgacctggggacgggaacccgccacgtggctgtcgaacctgaggtggccaaccttgatattatcggccagagaattgaaaatatcaaacatgagcacaagtccacatggcattacgacgaggataacccctataaaacctgggcttaccacgggagctatgaagtgaagccctctggatccgccagctccatggtcaatggcgttgtgaagctgctcacaaaaccttgggacgtgattcccatggtcacccaaatcgctatgacagataccacgcctttcggccagcagcgggtgtttaaggagaaagttgacacacgcaccccgaaggccaaaagagggaccgcgcaaatcatggaagtgacagcccggtggctgtggggattccttagcagaaacaagaagccccggatttgtacgcgcgaggaatttaccagaaaagtccggtctaatgctgccatcggcgctgtgttcgttgacgagaaccagtggaatagcgccaaggaggccgtggaagatgagcgcttttgggacctggtccatagagaacgggagctccacaaacaggggaagtgcgcgacatgcgtgtacaacatgatgggaaaacgcgaaaagaagctgggcgagttcgggaaagctaagggctccagagccatttggtacatgtggctgggagcccggtttctcgagttcgaagctctgggcttcatgaatgaggatcactggttttctcgcgaaaacagcctttccggggttgagggagagggcctgcataaactcgggtatatcctgagagacatttctaagatccctggaggcaatatgtacgccgatgacaccgctgggtgggatacacggatcaccgaagacgatcttcagaacgaggccaaaattacagacatcatggaacccgagcacgcgctgctcgccaaggctattttcaaactgacctatcaaaataaggtggtccgcgtgcagagacctgccaagaacggcacggtcatggatgtgatcagccggcgcgaccagagaggatccggccaggttgggacctacggactgaatacatttaccaacatggaagctcaactcattcggcagatggagtctgagggcatcttcagcccctccgaactggagacaccgaaccttgccgaaagagcgctggattggctcgagaaatatggggtggaacgcctgaagcggatggccatcagcggagacgactgtgtcgtgaaacctattgatgacagatttgctaccgcccttacggctctgaatgatatgggcaaggtgcgcaaagacatcccccagtgggagccttctaaggggtggaacgattggcagcaagttcccttctgctcccatcactttcaccagctcattatgaaggacggccgggagatcgtggtcccttgtagaaatcaggatgaactggtgggacgcgcccgggttagccagggcgctgggtggtctctgagagagacagcctgcctcggaaaatcctacgcgcaaatgtggcagctgatgtatttccatcgccgggaccttagactggccgctaacgccatttgtagcgccgtgcccgtcgattgggtgccgacctcccgcacaacctggtctatccacgctcatcaccagtggatgacgaccgaagacatgctcagcgtctggaatcgggtgtggattgaggaaaacccttggatggaggataagacacatatctccagctgggaggacgttccctacctgggcaaaagagaagaccaatggtgcgggtctcttatcggactgaccgcccgggcgacatgggctaccaatattcaggtggccatcaaccaggtcagacgcctcattggcaatgagaactacctggattatatgacatccatgaagcggtttaaaaatgaaagcgaccccgagggggccctgtggtga

SEQ ID NO: 18555 - RNA, 9879 nt, synthetic construct
  misc_feature 1..9879: note = derived and/or modified CDS sequence (opt5) from DENV-1__FJ639678__SS-prME
  source 1..9879: mol_type = other RNA
agcgtgacaatgctgctcatgctgatgcccacagcccttgctttccacctgacgaccagaggaggggaacctcatatgatcgtgtccaagcaggaacggggaaaagccctcctgtttaagacatctgcgggcgttaacatgtgcacccttattgctatggacctgggggagctctgtgaagatacaatgacctacaaatgcccgagaatcacagaggtggaacccgacgatgtggactgttggtgcaatgccaccgatacgtgggtcacctatggaacatgtcctcaaaccggcgagcaccggcgggaccgcagaagcgtggccctggctccccatgttgggctgggactcgagacacgggccgaaacctggatgtcctctgagggcgcttggaagcagattcagcgcgtggaaacgtgggccctgagacaccctggcttcacagtcatcgcgctttttctggcccatgctattgggaccagcatcacacagaaaggaatcattttcatcctcctgatgcttgtgaccccctccatggccatgcggtgcgttggcattgggaaccgcgattttgtggagggactgtctggcgctacctgggtcgacgtggtgctcgagcacgggagctgtgtcacaacgatggccaaggataagcctaccctggacatcgaactgctcaaaacagaggttaccaatccggcggtgctgagaaaactttgcattgaagccaaaatctccaacacaaccacggatagccggtgtcccacacaaggagaggctaccctggtggaagaacaggacgccaatttcgtctgccgcagaacctttgtggatcggggctggggcaacgggtgtggactcttcggcaaggggtctctgattacatgcgctaaatttaagtgcgttaccaaacttgagggaaaaatcgtgcagtacgaaaatctgaagtattccgtcatcgtgacagttcacacgggcgaccagcatcaagtggggaacgagagcaccgaacacggaacaaccgccacaattacccctcaggcccccacgtctgagatccagctcaccgactacggcgctctgacactggattgttcccctcgcaccggcctcgacttcaatgaaatggtcctgcttacaatgaaagaaaagagctggctggtgcataaacagtggtttctcgatctgccccttccgtggacctctggggcgtccacgagccaagagacatggaacagacaggacctgctcgtcaccttcaagacagcccacgctaaaaagcaggaagtggttgtgctgggatcccaagagggcgccatgcacaccgccctgaccggggctacagaaattcagacgtctggaaccacaaccatctttgccggccatctcaagtgccggctgaaaatggataaacttacactgaaagggatgagctatgtcatgtgtaccggctccttcaagctcgagaaagaagtggcggagacgcagcacggaacagttctggtgcagattaagtacgagggcaccgacgctccttgcaagatccccttcagcacccaagatgaaaaaggggtcacacagaatggaagactgatcaccgccaaccctattgtgacagacaaggagaaacccgtgaatatcgaagccgagcccccttttggcgagtcttatattgttatcggggctggagaaaaggcccttaaactctcctggttcaagaagggcagctctattgggaaaatgtttgaggctacggcccgcggcgcgcggagaatggccatcctgggagataccgcttgggacttcggcagcatcgggggagtctttacatccgtgggcaagctggtgcatcagattttcgggaccgcctacggagtcctcttttctggcgtgagctggacaatgaaaatcgggattggcgttctgcttacctggctgggactcaactcccgcagcacgtctctgtccatgacctgtatcgctgtgggcctggtcacactttacctcggggtgatggttcaggccgatagcggatgcgtgattaattggaagggccgggaactgaaatgtgggtctggaatcttcgtcaccaacgaggtgcacacatggaccgaacaatataagtttcaggcggactccccgaagagactgagcgccgctattggcaaagcctgggaggagggggtttgcggcatccgctccgctacacggctcgaaaacatcatgtggaagcagatttctaatgagctgaaccatatccttctggaaaatgacatgaaattcaccgtggtcgtgggagatgtggtcggcattctcgcccaggggaagaaaatgatcagaccccaacctatggagtacaagtatagctggaaatcctggggaaaggccaagattatcggcgctgacatccagaacacgacatttattatcgatgggcccaatacccctgaatgtcccgacgatcagcgcgcgtggaacatttgggaggttgaggactacggattcggcatctttaccacaaatatttggctgaaactgcgggattcttatacccaggtgtgcgaccacagacttatgagcgccgctatcaaggattccaaagccgtgcacgccgacatgggctactggatcgaaagcgagaagaacgaaacgtggaaactcgctcgcgcctctttcattgaggtcaagacatgtatctggccgaagtcccataccctgtggagcaatggggtgctggaatctgagatgattatccctaaaatttatggaggccccatctcccaacacaactaccggcctgggtacttcacacagaccgcgggaccctggcatctcggcaagctggagcttgattttgacctgtgcgaagggacaaccgttgtggtcgatgagcactgcggaaatagaggccctagcctccggacgaccacagtgaccggcaaaatcattcacgaatggtgttgccgctcttgtacactgcccccgctgagattcaagggggaggacggatgctggtatggcatggagatccggcctgttaaagaaaaggaggaaaaccttgtcaagagcatggtctccgctgggagcggagaggtggactctttttccctcggcctgctgtgtattagcatcatgattgaagaggttatgagatcccgctggtctcggaaaatgctcatgaccgggacgctggccgtgttctttcttctgatcatgggacagctcacatggaatgatctgattagactgtgcatcatggtcggcgccaacgctagcgaccgcatgggcatggggaccacataccttgccctgatggcgaccttcaagatgagacccatgtttgctgtgggactcctgttccggcgcctcacctccagagaggtgctgcttctgacaatcggcctctctctggtcgccagcgttgaactgcccaattcccttgaggaactgggggatggactcgccatgggcattatgatcctgaaactcctgacggactttcaatctcatcagctttgggctaccctgctcagcctgacattcattaagaccacattttccctgcactatgcctggaaaaccatggctatggtgcttagcatcgtgtctctgctccctctgtgtctctccacgacaagccagaagaccacctggctgccggtccttctggggtctctgggatgcaagcccctcacaatgttcctgattgccgagaacaaaatctggggccggaagtcctggcctcttaacgaaggcatcatggcggtggggattgttagcatcctgctctcttccctgctcaaaaatgatgtgcccctggccggacctcttattgctggcgggatgctgatcgcctgttacgtcattagcggatccagcgctgacctgtctctcgagaaggccgccgaggtgagctgggaagaggaagctgagcattccggcgcgtctcacaacatcctggttgaagtgcaggatgacgggaccatgaaaatcaaggatgaggagcgcgacgatacacttacgattctgctcaaagccaccctgctcgctgtcagcggagtgtatcccctgtccatccctgccacactttttctgtggtacttctggcaaaagaagaaacagagatctggcgtcctgtgggacacccccagcccgcctgaagtggagcgggccgttctcgatgacggcatttatcgcatcatgcagagagggctgcttggacggtcccaggtgggcgtcggggtgttccaagaaaatgtttttcatacaatgtggcacgtgacccgcggagctgtcctgatgtaccagggcaagagactcgagccctcttgggccagcgtgaaaaaggacctgatttcctacgggggaggctggcggctccagggcagctggaacacgggggaggaagtgcaggttatcgcggtcgagcctggcaagaatcccaagaacgtgcaaaccgctccgggcacattcaagacccctgaaggggaggtgggagccattgccctggattttaaacccggcacatctgggtcccctatcgtcaatagagaaggaaagatcgtgggcctttatggcaacggggttgtgaccacaagcggaacgtacgtctctgctattgcccaggcgaaggcttcccaggagggccccctgcccgagatcgaagacgaggtgttccgcaagcggaatctgaccattatggatctccaccctgggagcggaaaaacaagacgctatctgccggccatcgttcgggaagccattaagagaaaacttcgcaccctgatcctcgctcccacccgggtggtcgcctccgagatggctgaagccctgaaaggcatgcctatcagataccaaacaacggcggtgaagtctgagcataccgggaaagagattgttgacctgatgtgccacgccacatttaccatgcgcctccttagccccgtgcgggtccctaactataatatgatcattatggatgaagctcatttcacagacccctccagcatcgccgctagaggctacatttctacccgggtgggaatgggcgaggccgccgctatctttatgacggcgacacctccggggtccgtggaagccttcccccagagcaacgctgtcatccaggatgaggaacgcgacattcctgagagatcttggaatagcggatatgagtggatcaccgattttcccggcaagaccgtttggttcgtgccttccattaaatctgggaacgacatcgccaattgtctgcggaagaacggaaagcgcgtgattcagctgagcagaaaaacatttgataccgaataccaaaagaccaagaacaatgactgggactacgtcgtgaccacggatatctccgagatgggcgccaacttccgggctgacagagttattgatccccgccggtgcctcaagccggtgatcctgaaagacgggcaggaaagagtcatccttgccggccctatgcccgtgacagttgcgtctgctgcccagcgccggggaagaattggccgcaatcacaacaaggagggggatcagtatatctacatgggacaacccctgaataacgacgaggatcatgcccactggaccgaagctaagatgctcctggacaatattaacacacctgagggcatcattcccgccctgttcgaacctgagcgggaaaagagcgcggccatcgatggggagtatagactccgcggagaggctagaaagacctttgtggagcttatgcggcgcggcgacctgccggtctggctgtcctacaaagtggccagcgaggggttccagtattctgatagacggtggtgctttgacggcgaacgcaataaccaggtcctcgaggaaaatatggatgtggagatctggacgaaggagggagaacgcaagaagctgcggcccagatggcttgacgctcgcacctactccgaccctctggccctccgggagttcaaagaatttgctgccggcagacgcagcgtttccggggatctgattctggagatcggaaagctcccccagcaccttacacaaaaggcgcagaacgccctggacaatctggtgatgctccataactctgaacagggcgggcgggcttatagacacgccatggaggagctgcctgataccattgaaacacttatgctgctcgctctgatcgccgtgctgaccggaggcgtcacactcttctttcttagcggccgggggctgggaaaaacctccattggcctgctctgtgttatggcctctagcgctctgctttggatggcgtccgtggagccccattggatcgccgctagcatcattctggagttctttctcatggtgctgctgatcccggagcctgaccgccagagaacgccccaagataatcagctcgcctacgtcgtgattgggcttctgttcatgatcctgacagttgccgctaacgagatgggactcctggaaaccaccaagaaagaccttggcattgggcacgtggccgtcgagaaccaccatcacgcgacaatgctggatgtggacctccatcctgcctctgcttggaccctgtacgccgtcgctacaacgatcattacccccatgatgcggcacacaatcgaaaataccacagccaacatctccctgaccgcgattgccaatcaggctgccatcctcatgggacttgataagggctggcctattagcaaaatggacatcggcgtgcccctgctggctctcgggtgctattctcaagttaacccgctgacgcttaccgccgctgtgctgatgctcgtcgcccattacgcgattatcggacctggcctgcaggccaaggctacacgcgaggcccagaagagaaccgctgccgggatcatgaaaaatcccacagtggatggaattgttgccatcgacctggatcccgtggtctatgacgcgaagtttgaaaaacagctcggccaaattatgcttctgatcctgtgtacctcccagattctcctgatgcggacgacatgggctctttgcgagagcatcaccctggccacagggcctctcaccaccctgtgggagggatctccgggcaagttctggaacacaacgatcgctgtgagcatggccaatatttttcgcggctcctacctggccggggctggactcgccttctctcttatgaaaagcctgggcgggggaagacggggcaccggggcgcagggagaaacactgggcgagaagtggaagcgccagctcaaccaactgtccaaaagcgagttcaatacctataagagatccggcatcatggaggtggaccggtctgaagccaaagaggggcttaagagaggagagacaacccgccacgctgttagccggggcacggccaaactgagatggtttgtcgaacgcaacctcgtgaagcccgaggggaaggtgattgatctgggatgtggcagagggggatggtcctactattgcgctggcctgaaaaaggtcacagaagttaaaggctacaccaaagggggacctggccacgaggaacccatccctatggccacctacgggtggaatctcgtgaaacttcattctggaaaggacgtgttctttattccccctgagaaatgtgatacactgctgtgcgacatcggcgagagctccccgaaccccaccattgaagaggggagaacactccgcgtcctgaagatggtggaaccttggcttcggggaaatcagttctgtatcaagatcctgaacccctatatgccttctgttgtggagacgctcgagcagatgcagagaaaacacggcggcatgctggtccgcaatcccctgagccggaactccacccatgaaatgtactgggtgagctgcgggacaggaaatattgtttctgcggtgaacatgacctccagaatgctcctgaaccgctttacaatggcccaccggaagccgacctatgagagagatgtcgaccttggcgctgggacgcgccacgtggccgtggaacctgaggtcgctaatctggatatcattggacaaagaatcgaaaacattaaacatgagcacaagagcacctggcattacgacgaggataatccctataaaacatgggcctaccacggctcttatgaagttaagccctccgggagcgcttcttccatggtgaacggagtggtcaagctcctgaccaaaccttgggacgtgatccccatggttacacagatcgccatgaccgatacaacccctttcggccagcaacgggtgtttaaggagaaagtcgacacgcgcacaccgaaggcgaaacagggcaccgcccagattatggaagtgaccgctagatggctttgggggttcctgagccggaataagaagcccagaatctgtacacgggaggaatttacgcgcaaagttagatccaacgccgctattggagccgtgttcgtcgacgagaatcagtggaacagcgccaaggaggcggtggaagatgagcggttttgggacctcgttcatcgcgaaagagagctgcacaaacaaggcaagtgcgctacctgcgtgtacaatatgatggggaaacgggaaaagaagctgggagagttcggcaaagccaaggggtctcgcgccatctggtacatgtggctcggcgctagatttctggagttcgaagcccttggattcatgaacgaggatcactggtttagccgggaaaattccctgtctggcgtcgagggggagggactccataaactgggctatattcttcgcgacatcagcaagatccctgggggaaacatgtacgctgatgacacagccggctgggataccagaattacagaagacgatctgcggaatgaggcgaaaatcaccgacattatggaacccgagcacgccctcctggctacatccatcttcaagctgacctatcagaacaaagtggtccgcgtgcagagacctgccaagaatgggacggttatggatgtgatttctcggcgcgaccagagaggcagcggacaagtcggcacctacgggctcaacacatttaccaacatggaagctcagctgatccggcagatggagtccgagggaatcttctctcccagcgaacttgagacaccgaatctggccgaaagagtgctcgattggctggagaagtatggcgtggaacgccttaaacggatggcgatttccggggacgactgtgttgtgaagcctatcgatgacagatttgccaccgctctgacggccctcaacgatatgggaaaagtccgcaaggacattccccagtgggagcctagcaaaggctggaatgattggcaacaggtgcccttctgctctcatcactttcaccagctgatcatgaaggacgggcgggagattgttgtgccttgtagaaaccaggatgaactggtcggccgcgctcgggtgtcccaaggagccggctggagcctcagagagacagcttgcctggggaagtcttacgcccagatgtggcagcttatgtatttccatcgccgggacctgagactcgcggccaatgctatctgttccgccgtccccgtggattgggttccgaccagccgcacaacctggtccattcacgcccatcaccaatggatgacgaccgaagacatgctgtctgtgtggaaccgggtctggatcgaggaaaatccttggatggaggataaaacacatatcagctcctgggaggacgtgccctaccttggaaagagagaagaccagtggtgcggcagcctgattgggctcaccgctcgggccacatgggcgaccaacatccaggttgctattaatcaggtgagacgcctgatcggaaacgagaattacctggattatatgacatctatgaaacggtttaagaacgaatccgaccccgagggcgccctctggtga

SEQ ID NO: 18556 - RNA, 9879 nt, synthetic construct
  misc_feature 1..9879: note = derived and/or modified CDS sequence (opt5) from DENV-1__FJ639679__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgagaccacgaaacacgctgtttctagagggacagccaaacttcgctggtttgtcgagcggaatctggtgaaacccgaaggaaaggtgattgatctcggctgtgggagaggaggctggagctactattgcgctggcctgaagaaagtcaccgaggttaaggggtacaccaaaggaggccctgggcacgaagaacccatccctatggccacatacggatggaacctggtgaagctccattccggcaaagacgtgttctttattccccctgaaaagtgtgatacccttctgtgcgacatcggggagtctagcccgaatcccacaattgaggaaggacgcacgctgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgcggtgaatatgacatctcgcatgctgctcaaccggtttaccatggcccacagaaaaccgacgtatgaacgcgatgtcgacctgggggctggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagcgcgtgtttaaagaaaaggtcgacacaagaaccccgaaagcgaagcgggggaccgcccaaattatggaggtgacagctaaatggctgtggggattccttagcagaaacaagaagccccggatctgtacgcgcgaagagtttaccagaaaagttcggtctaatgccgctattggcgccgtgttcgtcgacgaaaaccagtggaatagcgccaaggaggcggtggaggatgaacgcttttgggacctggttcatagagagcgggaactccacaaacaggggaagtgcgctacatgcgtgtacaacatgatgggaaaacgcgagaagaagctgggcgagttcgggaaagccaagggctccagagccatctggtacatgtggctgggagctcggtttctcgagttcgaggccctgggcttcatgaatgaagatcactggttttctcgcgagaacagcctttccggggtcgaaggagagggcctgcataaactcgggtatattctgagagacatctctaagatccctggaggcaatatgtacgctgatgacaccgccgggtgggatacacggattaccgaggacgatcttcagaacgaagcgcgcatcacagacattatggagcccgaacacgccctgctcgctaaaagcatcttcaagctgacctatcaaaataaagtggtcagagtgcagcggcctgccaagaacggcacggttatggatgtgatttcccgcagagaccagcggggatctggccaggtcgggacctacggactgaatacatttaccaacatggaggctcaactcatcagacagatggaaagcgagggcatcttctcccccagcgagctggaaacaccgaaccttgccgcgcgcgtgctggattggctcgagaagtatggggtggaacggctgaaaagaatggccatttctggagacgactgtgttgtgaagcctatcgatgaccgctttgctaccgcccttacggctctgaatgatatgggcaaagtccggaaggacattccccagtgggagccttccaaagggtggaacgattggcagcaagtgcccttctgcagccatcactttcaccagctcatcatgaaggacggcagagaaattgttgtgccttgtcgcaatcaggatgagctggtcggacgggccagagtgtctcagggcgctgggtggtccctgcgcgagacagcctgcctcggaaagagctacgcgcaaatgtggcagctgatgtatttccatcggagagaccttcgcctggccgctaacgccatctgttccgccgtccccgtggattggattccgacctctcggacaacctggagcatccacgctcatcaccagtggatgacgaccgaagacatgctctccgtttggaatagagtgtggatcgaggaaaacccttggatggaggataaaacacatattagctcttggggcgacgtcccctacctggggaagcgggaagaccaatggtgcggatcccttatcggcctgaccgccagagcgacatgggctaccaatattcaggtggccatcaaccaggttcgccggctcattgggaatgagaactacctggattatatgacaagcatgaaaagatttaagaatgagtctgaccccgaaggcgccctgtggtga

SEQ ID NO: 18557 - RNA, 9879 nt, synthetic construct
  misc_feature 1..9879: note = derived and/or modified CDS sequence (opt5) from DENV-1__FJ850069__SS-prME
  source 1..9879: mol_type = other RNA
agcgtgaccatgctgctcatgctgatgcccacagcccttgctttccacctgacgaccagaggcggggagcctcatatgatcgtcggaaagcaggaacggggcaaatccctcctgtttaagacatctgccggggttaacatgtgcacccttattgcgatggacctgggagagctctgtgaagatacaatgacctacaaatgcccgcgcatcacagaggtggaacccgacgatgtggactgttggtgcaataccacggatacctgggtcacatatggcacctgtagccaaacaggggagcacagacgggacaagcgctccgtggctctggcccctcatgttggactgggcctcgagaccagagccgaaacgtggatgtctagcgagggcgcttggaaacagattcagcgggtggaaacatgggccctgcgccaccccgggttcaccgtcatcgctctttttctggcccatgtgattggaacatccatcacccagaagggcatcattttcatcctcctgatgcttgttaccccttctatggcgatgagatgcgtggggattggaagccgggattttgtcgagggcctgtccggggccacatgggtggacgtggtcctcgagcacggaagctgtgttacgaccatggctaaggataaacccacactggacatcgaactgctcaagaccgaggtgacaaaccctgccgtgctgcgcaaactttgcattgaagctaagatctctaataccacgacagattccagatgtccgacccaaggcgaggccaccctggtcgaagagcaggacgcgaacttcgtgtgccggcgcacatttgttgatagaggctgggggaatggatgtggcctcttcgggaaaggaagcctgattacctgcgccaagtttaagtgcgtgacaaaacttgagggcaagatcgtccagtacgaaaacctgaaatattctgtgatcgttacggtgcacaccggggaccagcatcaagtcggaaatgagtccacagaacacggcaccacagctaccattacgccccaggcccctaccagcgagatccagctcacagactacggcgctctgaccctggattgttctccccggacagggctcgacttcaacgaaatggtgctgcttaccatgaaggagaaatcctggctggtccataagcagtggtttctcgatctgcctcttccctggacgagcggagcctccacatctcaagagacctggaatcgccaggacctgctcgtgacattcaaaaccgcccacgctaagaagcaggaagttgtggtcctgggcagccaagagggggcgatgcacaccgccctgacaggagctacggaaattcagacctccggcacaaccacaatctttgccgggcatctcaaatgcagactgaagatggataaacttaccctgaagggcatgagctatgtgatgtgtacgggatctttcaaactcgagaaggaagttgccgagacacagcacggcaccgtgctggtccagattaagtacgaggggaccgacgctccgtgcaaaatccctttctccacacaagatgaaaagggagtgacccagaacggccggctgatcacagccaatcccattgtgacggacaaagagaagcctgttaacatcgaagcggagcccccctttggggagagctatattgtcatcggagctggcgaaaaagcccttaagctctcttggttcaagaaagggagctccattggcaagatgtttgaggccaccgctagaggagcccgccggatggctatcctgggcgatacagcctgggacttcgggtctatcggaggcgtgtttaccagcgtggggaaactggtccatcagattttcggaacagcgtacggcgtgctcttttccggggttagctggaccatgaagatcggcattggagtgctgcttacgtggctgggcctcaattctagatccaccagcctgtctatgacatgtatcgccgtcgggctggtgaccctttacctcggagttatggtgcaggctgattccggctgcgtcattaactggaaagggcgcgaactgaagtgtggaagcggcatcttcgtgacaaatgaggttcacacctggacagaacaatataagtttcaggccgactcccctaaacggctgtctgctgccattgggaaggcgtgggaggagggcgtgtgcggaatcagaagcgccacccgcctcgaaaacatcatgtggcggcagatttccaacgagctgaatcatatccttctggaaaacgacatgaaattcacggtcgtggtgggcgatgtcgttgggattctcgctcagggaaagaaaatgatcagaccgcaacccatggagcacaagtactcttggaaaagctggggcaaggccaagattatcggggctgacgtgcagaatacaacctttatcattgatggacctaacacccccgaatgtcctgacgatcagcgcgcctggaatatctgggaggtggaggactatggcttcggcatttttacaaccaacatctggctgaaactgcgggattcctacacgcaggtctgcgaccacagacttatgagcgccgctattaaggattctaaagcggtgcatgccgacatggggtattggatcgaatccgagaagaatgaaacatggaaactcgctcgcgccagcttcatcgaggttaagacctgtatttggcccaagtctcacacactgtggtccaacggagtgctggaaagcgagatgatcattccgaaaatctacggcgggcctatttctcaacataattatcggcccggatacttcacccagacagccggcccttggcacctcgggaagctggagcttgattttgacctgtgcgaaggaaccacggtcgtggttgatgagcactgcggcaacagaggccccagcctccggaccacaaccgtgacagggaaaatcatccatgaatggtgttgccgctcctgtaccctgcctcccctgagattcaagggagaggacggctgctggtacgggatggagattcggccggtcaaagaaaaggaggaaaatcttgtgaagagcatggtttctgctggatccggcgaggtggacagcttttccctcgggctgctgtgtatctctattatgatcgaagaggtcatgagaagccgctggtcccggaaaatgctcatgacgggaacactggccgtgttctttcttctgattatgggccagctcacctggaacgatctgatcagactgtgcattatggtgggcgcgaatgcttctgaccgcatggggatgggaacaacctatcttgccctgatggccaccttcaagatgagacctatgtttgctgtcggcctcctgttccggcgcctcacaagcagagaggttctgcttctgacgatcgggctctccctggtggcctctgtggaactgcccaacagccttgaggaactgggagatggcctcgcgatggggatcatgattctgaaactcctgaccgactttcaatcctaccagctttgggtcacactgctcagcctgaccttcatcaagacaaccttttctctgcactatgcttggaaaacgatggccatggtgctttccattgttagcctgctccccctgtgtctctctacaacctcccagaagaccacatggctgcctgtgcttctgggaagcctgggctgcaagccgctcaccatgttctttatcgccgagaataaaatttggggccggaagtcttggcccctgaacgaagggatcatggctgtcggaatcgtgtccattcttctgagctccctcctgaaaaacgatgttcctctcgccggccccctgatcgctgggggaatgcttattgcctgttacgtgatcagcggctctagcgcggacctgtccctggagaaggccgctgaggtctcttgggaagaggaagccgagcatagcggggcttcccacaatattctcgtggaagtccaggatgacggaacaatgaaaatcaaggatgaggagcgcgacgatacgctgaccatccttctgaaagccacactcctggccgtgtctggcgtttatcctctcagcattcccgctaccctgttcgtgtggtacttctggcaaaagaagaaacagagatccggcgtcctttgggacacaccttctcccccggaagtggagcgggcggttctggatgacgggatctatcgcattatgcagagaggactgctcggccggagccaggtgggggtcggagtgtttcaagaaaacgtgttccataccatgtggcacgttacgcgcggcgccgtcctgatgtaccaggggaagagacttgagccttcctgggctagcgtgaaaaaggacctgatctcttacggaggcggctggcggctccaggggtcctggaataccggagaggaagtgcaggtcattgccgtggagcccggcaaaaaccctaagaatgttcaaacagcccccgggacctttaagacaccggaaggagaggtgggcgctatcgccctggatttcaaacctgggaccagcggatctcccattgtcaacagagaaggcaagatcgtgggcctctatgggaatggagttgtgacaacgtccggcacctacgtcagcgcgatcgctcaggccaaagcctcccaggaggggcctctgcccgagattgaagacgaggtgtttcgcaagcggaaccttacaatcatggatctgcaccccggatctggcaaaaccagacgctatctgcctgctattgttcgggaagccatcaagagaaagctccgcaccctgattcttgcgccgacacgggtggtcgctagcgagatggccgaagccctgaaagggatgcccatcagataccaaacgaccgctgtgaagtccgagcatacaggccgcgagatcgtggacctcatgtgccacgccaccttcacaatgcggctgctgagccctgtcagagttcccaattataacatgattatcatggatgaagctcattttaccgacccttcttccattgccgcgcggggatacatcagcacgcgcgtgggcatgggggaggccgctgccattttcatgacagctaccccccctggatctgtggaagcctttccgcagagcaatgccgtcatccaggatgaggaaagagacatccccgagcggtcctggaactctggctatgagtggattaccgatttccctgggaaaacagtgtggtttgttcccagcatcaagtccggaaatgacattgctaactgtctccgcaaaaatggcaagagagtgatccagctttctcggaagaccttcgatacagaataccaaaaaaccaagaacaacgactgggactacgtcgtgacgacagatattagcgagatgggggcgaatttcagagccgaccgcgttatcgatcctcggagatgcctgaaacccgtgattctgaaggacggcccggaacgcgtcatcctcgctggacctatgcccgtgaccgtcgcctccgccgctcagcggagaggccgcatcgggcggaaccacaataaagagggagatcagtatatttacatgggccagcccctgaacaatgacgaggatcatgcccactggacagaagcgaagatgcttctggacaacatcaatacccctgaggggattatccccgctctctttgaacctgagagagaaaagagcgccgccattgatggagagtatcgcctgagaggcgaggctcggaaaacgttcgtggaactgatgcgcagaggggacctcccggtttggctttcttacaaggtggcctccgagggctttcaatatagcgatcggcgctggtgcttcgacggagaaagaaacaatcaggtgctggaggaaaacatggatgtcgagatctggaccaaagagggcgaacggaagaaactgagaccccgctggctcgacgcgcggacatactccgaccctctggcccttagagagtttaaggaattcgctgccgggcgccggtctatcagcggagatctgattctcgagatcggcaaactgccccagcacctgacccagagagctcaaaatgccctcgacaaccttgttatgctgcataattccgaacaggggggacgggcttatcgccacgccatggaggagctgcctgatacaattgaaaccctcatgctgcttgcgctgatcgccgtgctcacaggcggcgtgaccctgtttttcctgtctgggagaggactcggcaagacgagcattgggcttctgtgtgtcatggcttccagcgccctgctctggatggcttctgtggagccccattggatcgccgcctccatcattctggaatttttccttatggttctgctcatcccggagcctgaccggcagcgcacaccccaggataaccaactggcttacgtggtcattggactgctctttatgatccttaccgtggcggccaatgagatgggcctgctggaaaccacaaagaaagacctcgggattggacacgtcgctgtggagaaccaccatcacgccaccatgctggatgttgaccttcatcctgccagcgcttggacactgtacgccgtggcgacgaccatcattacacccatgatgagacacaccatcgaaaacacaaccgccaatatctctctcacggctattgccaaccaggctgccatcctgatgggcctggataagggctggcctatttccaaaatggacatcggggtccccctccttgcgctgggatgctatagccaggtgaatccgctgaccctcacagccgctgttctgatgcttgtggcccattacgctattatcggccctgggctgcaagccaaggctacccgggaggcccagaaacgcacagcggccggaatcatgaagaaccccaccgtcgatggcattgtggctatcgacctcgatcccgtggtttatgacgccaagttcgaaaaacagctggggcagattatgctgctcatcctttgtacgtctcaaattctgctgatgagaacaacctgggctctctgcgagagcatcacactggccaccggacctcttaccacactgtgggagggctccccgggcaagttttggaatacgaccatcgccgtctctatggcgaacattttccgggggagctacctcgctggagccggcctggctttctccctgatgaaaagcctcgggggaggccgcagagggacaggagcccagggcgaaacccttggcgagaagtggaaacggcagctgaatcagctgtccaagtctgaatttaacacatataagagaagcgggatcctcgaggtggaccgctccgaagccaaagagggactgcggagaggcgagaccacgaagcacgctgtgtctcgcgggacagccaaacttcggtggttcgtcgaaagaaatctggttaagcccgagggaaaagtgattgatctcggctgtgggcgcggaggctggagctactattgcgcgggcctgaagaaggtgaccgaagtcaaagggtacaccaagggaggccctgggcacgaggaacccatccctatggccacatacggatggaacctggtgaaactccattccggcaaggacgtttttttcattccccctgagaaatgtgatacccttctgtgcgacatcggggagtctagcccgaatcccacaattgaagagggacggacgctgagagtgctcaagatggtcgaaccttggctgcgcggcaaccaattttgtatcaaaatccttaatccctatatgccttccgtggttgagaccctggagcagatgcagcggaagcacggcgggatgctcgtgagaaaccccctgagccgcaattctacacatgaaatgtactgggtctcctgcggaaccggcaacattgtgagcgctgtgaatatgacatctcggatgctgctcaacagattcaccatggcccaccgcaagccgacgtatgagagagatgtcgacctgggggctggaacccggcacgttgccgtggaacctgaggtggcgaaccttgatatcattggccagcgcatcgaaaatattaaacatgagcacaagtccacatggcattacgacgaggataacccctataaaacctgggcctaccacgggagctatgaagtcaagccctctggatccgctagctccatggtgaatggcgttgtgaaactgctcacaaagccttgggacgtcatccccatggtgacccaaatcgccatgacagataccacgccttttggccagcagagagttttcaaggagaaagtggacacacggaccccgaaggctaaaagagggaccgcccaaattatggaagtcacagctggatggctgtggggctttcttagccggaacaagaaaccccgcatctgtacgagagaggaattcacccggaaggtgcgctctaatgccgcgattggggccgtttttgtggacgagaaccagtggaatagcgctaaggaggccgtcgaagatgagagattctgggacctggtgcatcgggaacgcgagctccacaaacagggaaagtgcgctacatgcgtctacaacatgatgggcaaaagagaaaagaaactgggggagtttggcaaggccaagggatcccgggccatctggtacatgtggctgggcgcgcgcttcctcgagttcgaagctctggggtttatgaatgaggatcactggttctctagagaaaacagcctttccggagtggagggcgaggggctgcataaactcggatatattctgcgggacatctctaagatccctggcgggaatatgtacgccgatgacaccgccggctgggatacacgcattaccgaagacgatcttcagaacgaggctaaaatcacagacattatggaacccgagcacgccctgctcgctaccagcatctttaagctgacgtatcaaaataaagttgtgagagtccagcggcctgccaagaacggaaccgtgatggatgtgatttcccgcagagaccagcggggctctgggcaggttggaacatacggcctgaataccttcacaaacatggaagcgcaactcatcagacagatggagagcgaggggatcttttcccccagcgaactggagaccccgaaccttgccgaacgcgtgctggattggctcgagaaatatggagtcgaacggctgaagagaatggctatttctggcgacgactgtgtggttaagcctatcgatgaccgcttcgccacggctcttacagccctgaatgatatggggaaagtgcggaaggacattccccagtgggagccttccaaaggctggaacgattggcagcaagtccccttttgcagccatcacttccaccagctcatcatgaaggacggaagagagattgtggtcccttgtcgcaatcaggatgaactggtgggccgggcgagagtttctcagggggccggatggtccctgcgcgagaccgcttgcctcggcaaaagctacgcccaaatgtggcagctgatgtattttcatcggagagaccttcgcctggctgccaacgctatctgttccgccgtgcccgtcgattgggtgccgacatctcggaccacgtggagcattcacgcgcatcaccagtggatgaccacagaagacatgctctccgtttggaatagagtgtggatcgaggaaaacccttggatggaggataagacccatatcagctcttgggaggacgtcccctacctggggaagcgggaagaccaatggtgcggatcccttattggcctgacagccagagctacctgggccacaaatatccaggtggccattaaccaggtgcgccggctcatcgggaatgagaactacctggattatatgaccagcatgaaaagattcaagaatgaatctgacacggagggcgctctgtggtga

SEQ ID NO: 18558 - RNA, 9879 nt, synthetic construct
  misc_feature 1..9879: note = derived and/or modified CDS sequence (opt5) from DENV-1__FJ639680__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcaccggcgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggcccaggggaaaaagatgatccggccgcaacccatggagtacaaatattcttggaaaagctggggaaaggccaagattatcggcgctgacgcgcagaataccaccttcatcattgatgggcctaacacacccgaatgtcctgacgatcagagagcctggaatatctgggaggtggaggactacggatttggcattttcaccacgaacatctggctgaaacttcgcgattcctatacacaggtctgcgaccaccggctcatgagcgctgccattaaagattctaaggccgttcacgctgacatgggctactggatcgaatccgagaaaaatgaaacctggaagctggccagagcgagctttatcgaggtgaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggatttcgacctctgcgaagggacgaccgtcgtggttgatgagcactgcggaaaccggggccccagcctgagaacaaccacagtgaccggcaagatcatccacgaatggtgttgccggtcctgtacgctgcctccccttcgctttagaggggaggacggatgctggtatggcatggagattcggccggtcaaagaaaaggaggaaaatctcgtcaagagcatggtttctgccgggtccggagaggtggacagcttctccctgggcctgctctgtatctctattatgatcgaagaggtcatgagaagccgctggtcccggaaaatgctgatgacagggacccttgccgtgtttttcctgctcattatgggacagctgacatggaacgatctgatcagactttgcattatggttggcgctaatgcctctgaccgcatgggcatggggaccacctacctggcgctcatggctacatttaagatgagacctatgttcgccgtgggactgctctttcggcgcctgacgagcagagaggtccttctgctcaccatcggcctgtccctggtggcctctgtggaacttcccaacagcctggaggaactcggggatggactggctatgggcatcatgattctcaaactgcttacagacttccaatcccatcagctgtgggccaccctcctgagcctgacatttatcaagaccacgttctctcttcactatgcttggaaaacaatggccatggtcctgtccattgttagcctctttcccctgtgtctctctaccacctcccagaagacaacctggctgcctgtgcttctggggagcctgggatgcaagccgctcacaatgttcctgatcgcggagaataaaatttggggccggaagtcttggccccttaacgaaggcatcatggccgtggggatcgtctccattctgctcagctccctgctcaaaaacgatgtgcctctggctggaccccttatcgccggcgggatgctgattgcttgttacgttatcagcggatctagcgccgacctgtccctcgagaaggccgctgaggtgtcttgggaagaggaagcggagcatagcggcgcctcccacaatattctggtcgaagtgcaggatgacgggacgatgaaaatcaaggatgaggagcgcgacgatacccttacaatcctgctcaaagctaccctgctcgccgtttctggagtgtatcctctgagcattcccgccacactttttgtctggtacttctggcaaaagaagaaacagagatccggcgtgctgtgggacaccccttctcccccggaagtcgagcgggctgtgctggatgacggcatctatcgcattatgcagagagggctcctgggacggagccaggttggcgtgggggtcttccaagaaaacgtgtttcatacgatgtggcacgttacccgcggagccgtgcttatgtaccagggcaagagactggagccttcctgggcgagcgtcaaaaaggacctcatctcttacgggggaggctggcggctgcagggctcctggaatacaggggaggaagtccaggtgattgctgttgagcccggcaagaaccctaagaatgtccaaaccgcccccggcacattcaagaccccggaaggggaggtgggagccatcgctctcgattttaaacctggcacaagcgggtctcccattgtgaacagagaaggaaagatcgtcggcctgtatggcaatggggtggttacgacctccggaacatacgtgagcgccatcgcgcaggctaaagcctcccaggagggccctcttcccgagattgaagacgaggtcttccgcaagcggaacctgaccatcatggatctgcaccccgggtctggaaaaaccagacgctatctccctgccattgtgcgggaagctatcaagagaaagctgcgcacacttattctggccccgacgcgggttgtggctagcgagatggccgaagcgctcaaaggcatgcccatcagataccaaaccacagccgtcaagtccgagcataccgggaaagagatcgtggacctgatgtgccacgctacatttaccatgcgcctgctcagccctgttcgggtgcccaattataacatgattatcatggatgaagcccatttcacggacccttcttccattgctgccagaggctacatcagcacacgggtcggaatgggcgaggccgctgcgatttttatgaccgccacaccccctgggtctgtggaggctttcccgcagagcaatgccgtgatccaggatgaggaacgcgacatccccgagagatcctggaactctggatatgagtggattacagattttcctggcaagaccgtctggttcgttcccagcatcaaatccgggaatgacattgccaactgtcttcggaagaatggaaagcgcgtgatccagctgtctagaaaaacatttgataccgaataccaaaagacgaaaaacaacgactgggactacgtggtcacaaccgatattagcgagatgggcgctaatttccgggccgacagagtgatcgatcctcgccggtgcctgaagcccgttattctcaaagacgggccggaaagagtgatcctggcgggccctatgcccgtcacagtggcttccgccgcccagcgccggggaagaatcggccgcaaccacaataaggagggggatcagtatatttacatgggacagccccttaacaatgacgaggatcatgctcactggaccgaagccaagatgctgctcgacaacatcaatacgcctgagggcattatccccgcgctgttcgaacctgagcgggaaaagagcgccgctattgatggggagtatagactgcgcggagaggccagaaagacctttgttgagctcatgcggcgcggcgaccttccggtgtggctgtcttacaaagtcgcttccgaggggttccaatatagcgatagacggtggtgctttgacggcgaacgcaacaatcaggtgctggaggaaaacatggatgtcgagatctggacaaaggagggagaacgcaagaagctccggcccagatggctggacgcccgcacctactccgaccctcttgctctgcgggagttcaaagaatttgccgcgggcagacgctctgtgagcggggatctcatcctggagattggaaagctgccccagcacctcacacagcgggcccaaaatgctcttgacaacctggttatgctgcataattccgaacagggcgggagagcctatcggcacgctatggaggagctccctgataccatcgaaacactgatgcttctggccctcattgccgtgctgaccggaggcgtgacgctgttctttctctctggccgcgggcttggaaagacaagcatcggcctgctgtgtgtcatggcttccagcgttctcctgtggatggcgtctgtggagccccattggattgccgcttccatcatccttgagttctttctgatggtgctcctgattccggagcctgacagacagcggacaccccaggataaccaactggcctacgtcgtgatcgggctccttttcatgattctgaccgttgccgctaatgagatgggactgctcgaaacaaccaaaaaggacctgggcatcgggcacgtggccgtcgagaaccacaaccatgcggccatgcttgatgtggacctgcaccctgctagcgcctggacactctacgctgtcgccacgaccattatcacacccatgatgcgccataccattgaaaatacaaccgcgaacatctctctgacggccatcgctaatcaggccgctattctgatgggactcgataaaggctggcctatctccaagatggacattggcgtgccccttctggccctggggtgctatagccaggttaacccgctcaccctgacagctgccgtgcttatgctggtcgcgcactacgccatcattggacctggcctccaagctaaagccaccagagaggctcagaagcggacagccgccgggatcatgaagaatcccaccgtggatggaatcgttgcgattgacctggatcccgtggtctatgacgctaaatttgaaaagcagctgggccagatcatgctccttattctgtgtacgtctcaaatcctgctcatgcgcacaacctgggccctgtgcgagagcattacacttgctaccgggcctctgaccacactctgggagggatccccgggcaaattctggaacacgaccatcgccgtgtctatggccaatatctttagaggcagctacctggctggggccggactggcgttctccctcatgaaaagccttggcgggggacggcgcggcacaggggcccagggagaaaccctgggcgagaaatggaagagacagctgaaccagctctccaagtctgagttcaatacatataaacggagcggcattatggaggtggacagatccgaagctaaggaggggctgaaacgcggagagaccacgaagcatgccgtttctcggggcacagctaaacttagatggtttgtcgaacgcaacctggtgaagcccgaggggaaggtgatcgatctcggatgtggcagagggggatggagctactattgcgccggcctgaaaaaggtcaccgaagttaaaggctacaccaaagggggacctggccacgaggaacccattcctatggcgacatacgggtggaatctggtgaaactccactccggaaaggacgtgttctttattccccctgagaaatgtgatacccttctgtgcgacatcggcgagtctagcccgaaccccacaatcgaagaggggagaacgctgcgcgtcctcaagatggtggaaccttggctgcggggaaatcaattctgtattaagatccttaacccctatatgccttccgttgtggagaccctggagcagatgcagagaaaacatggcggcatgctcgtccgcaatcccctgagccggaactctacacacgaaatgtactgggtgtcctgcgggaccggaaatatcgttagcgccgtgaacatgacatctagaatgctgctcaaccgctttaccatggctcatcggaagccgacgtatgagagagatgtcgacctgggcaccgggacacgccacgtggccgtggaacctgaggtcgctaatcttgatattatcggacagagaattgaaaacatcaaacacgagcataagtccacctggcactacgacgaggataatccctataaaacatgggcctaccatggcagctatgaagttaagccctctgggtccgctagctccatggtgaacggagtggtcaagctgctcaccaaaccttgggacgtgattcccatggttacacaaatcgccatgaccgatacgacacctttcggccagcagcgggtgtttaaggagaaagtcgacacccgcaccccgaaggcgaaaagaggcacagcccaaatcatggaagtgacggctcggtggctgtgggggttccttagcagaaataagaagccccggatttgtacccgcgaggaatttacaagaaaagttcggtctaacgccgctatcggagccgtgttcgtcgacgagaatcagtggaacagcgccaaggaggcggtggaagatgagcgcttttgggacctggttcacagagaacgggagctccataaacagggcaagtgcgctacctgcgtgtacaatatgatggggaaacgcgaaaagaagctgggagagttcggcaaagccaaggggtccagagccatttggtacatgtggctgggcgctcggtttctcgagttcgaagccctgggattcatgaacgaggatcactggttttctcgcgaaaatagcctttccggcgtcgagggggagggactgcacaaactcggctatatcctgagagacatttctaagatccctgggggaaacatgtacgctgatgacacagccggctgggatacccggatcacagaagacgatcttcagaatgaggcgaaaattaccgacatcatggaacccgagcatgccctgctcgctaaggccattttcaaactgacgtatcaaaacaaggtggtccgcgtgcagagacctgctaagaatgggaccgttatggatgtgatcagccggcgcgaccagagaggctccggacaggtcggcacatacgggctgaacacctttacaaacatggaagcccaactcattcggcagatggagtctgagggaatcttcagcccctccgaactggagaccccgaatcttgcggaaagagccctggattggctcgagaaatatggcgtggaacgcctgaagcggatggctatcagcggggacgactgtgtggttaaacctattgatgacagatttgccacggctcttacagccctgaacgatatgggaaaggtgcgcaaagacatcccccagtgggagccttctaagggctggaatgattggcagcaagtccccttctgctcccaccattttcaccagctcattatgaaggacgggcgggagatcgtggttccttgtagaaaccaggatgaactggtgggccgcgctcgggtcagccagggagccggctggtctctgagagagaccgcgtgcctcgggaaatcctacgcccaaatgtggcagctgatgtatttccaccgccgggaccttagactggctgccaatgccatttgtagcgctgtgcccgtcgattgggtgccgacatcccgcaccacgtggtctatccatgcccaccatcagtggatgaccacagaagacatgctcagcgtttggaaccgggtgtggattgaggaaaatccttggatggaggataagacccacatctccagctgggaggacgtcccctacctgggaaaaagagaagaccaatggtgcggctctcttatcgggctgacagcgcgggctacctgggccacaaacattcaggtggccatcaatcaggttagacgcctcattggaaacgagaattacctggattatatgacctccatgaagcggtttaaaaacgaaagcgaccccgagggcgctctgtggtga

SEQ ID NO: 18559 - RNA, 9879 nt, synthetic construct
  misc_feature 1..9879: note = derived and/or modified CDS sequence (opt5) from DENV-1__FJ639682__SS-prME
  source 1..9879: mol_type = other RNA
agcgtgacaatgctgctcatgctgatgcccacagcccttgctttccacctgacgacccggggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagagaagacacttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagctcaccgttgtggtcggagatgtggccggcattctggctcaggggaaaaagatgatccggccgcaacccatggagtacaaatattcttggaaaagctggggaaaggccaagattatcggcgccgacgctcagaataccacattcatcattgatgggcctaacacccccgaatgtcctgacgatcagagagcgtggaatatctgggaggtggaggactacggatttggcattttcacgacaaacatctggctgaaacttcgcgattcctatacccaggtctgcgaccaccggctcatgagcgccgctattaaagattctaaggccgttcacgccgacatgggctactggatcgaatccgagaaaaatgaaacatggaagctggctagagccagctttatcgaggtgaagacctgtatttggcccaaatctcatacactgtggtccaacggggtgctcgaaagcgagatgatcattccgaagatctatggaggccctatttctcaacacaattaccgccccgggtacttcacccagacggcgggaccttggcatctgggcaaacttgagctggatttcgacctctgcgaagggaccacagtcgtggttgatgagcactgcggaaaccggggccccagcctgagaaccacaaccgtgacgggcaagatcatccacgaatggtgttgccggtcctgtacactgcctccccttcgctttagaggggaggacggatgctggtatggcatggagattcggccggtcaaagaaaaggaggaaaatctcgtgaaaagcatggtttctgctgggtccggagaggtggacagcttctccctgggcctgctctgtatctctattatgatcgaagaggtcatgagaagccgctggtcccggaaaatgctgatgaccgggacacttgccgtgtttttcctgctcattatgggacagctgacctggaacgatctgatcagactttgcattatggttggcgccaatgcttctgaccgcatgggcatggggaccacatacctggccctcatggcgacgtttaagatgagacctatgttcgctgtgggactgctctttcggcgcctgaccagcagagaggtccttctgctcacaatcggcctgtccctggtggcctctgtggaacttcccaacagcctggaggaactcggggatggactggccatgggcatcatgattctcaaactgcttaccgacttccaatcccatcagctgtgggctacactcctgagcctgacctttatcaagacgacattctctcttcactatgcctggaaaaccatggctatggtcctgtccattgttagcctctttcccctgtgtctctctaccacatcccagaagaccacatggctgcctgtgcttctggggagcctgggatgcaagccgctcacgatgttcctgatcgccgagaataaaatttggggccggaagtcttggccccttaacgaaggcatcatggcggtggggatcgtctccattctgctcagctccctgctcaaaaacgatgtgcctctggccggaccccttatcgctggcgggatgctgattgcctgttacgttctgagcggatctagcgctgacctctccctggagaaggccgccgaggtgtcttgggaagaggaagctgagcatagcggcgcgtcccacaatatccttgtcgaagtgcaggatgacgggaccatgaaaattaaggatgaggagcgcgacgatacactgaccatcctcctgaaagccacactcctggctgtttctggagtgtatcctcttagcatccccgccaccctgtttgtctggtacttctggcaaaagaagaaacagagatccggcgtgctgtgggacacgccttctcccccggaagtcgagcgggccgtgctcgatgacggcatttatcgcatcatgcagagagggctgcttggacggagccaggttggcgtgggggtcttccaagaaaacgtgtttcataccatgtggcacgttacacgcggagctgtgctgatgtaccagggcaagagactcgagccttcctgggccagcgtcaaaaaggacctgatttcttacgggggaggctggcggctccagggctcctggaataccggggaggaagtccaggtgatcgcggttgagcccggcaagaaccctaagaatgtccaaacagctcccggcaccttcaagacaccggaaggggaggtgggagccattgccctggattttaaacctggcacgagcgggtctcccatcgtgaacagagaaggaaagattgtcggcctttatggcaatggggtggttaccacatccggaacctacgtgagcgctatcgcccaggcgaaggcttcccaggagggccctctgcccgagatcgaagacgaggtcttccgcaagcggaacctgaccattatggatctccaccccgggtctggaaaaacaagacgctatctgcctgccatcgtgcgggaagccattaagagaaaacttcgcacgctgatcctcgctccgacccgggttgtggccagcgagatggctgaagccctgaaaggcattcccatcagataccaaacaaccgcggtcaagtccgagcatacagggaaagagatcgtggacctgatgtgccacgccacctttacgatgcgcctccttagccctgttcgggtgcccaattataacatgattatcatggatgaagctcatttcacagacccttcttccattgccgctagaggctacatcagcacccgggtcggaatgggcgaggccgccgctatttttatgaccgcgacaccccctgggtctgtggaagccttcccgcagagcaatgctgtgatccaggatgaggaacgcgacatccccgagagatcctggaactctggatatgagtggattaccgattttcctggcaagacagtctggttcgttcccagcatcaaatccgggaatgacattgccaactgtctgcggaagaatggaaagcgcgtgatccagctgtctagaaaaacctttgatacggaataccaaaagaccaagaacaacgactgggactacgtggtcaccacagatattagcgagatgggcgccaatttccgggctgacagagtgatcgatcctcgccggtgcctcaagcccgttattctgaaagacgggccggaaagagtgatccttgccggccctatgcccgtcaccgtggcgtccgctgcccagcgccggggaagaatcggccgcaaccacaataaggagggggatcagtatatttacatgggacagcccctgaacaatgacgaggatcatgcccactggacggaagctaagatgctcctggacaacatcaatacccctgagggcattatccccgccctgttcgaacctgagcgggaaaagagcgcggccattgatggggagtatagactccgcggagaggctagaaagacatttgttgagcttatgcggcgcggcgacctgccggtgtggctgtcttacaaagtcgcctccgaggggttccaatatagcgatagacggtggtgctttgacggcgaacgcaacaatcaggtgctcgaggaaaacatggatgtcgagatctggaccaaggagggagaacgcaaaaagctgcggcccagatggcttgacgctcgcacatactccgaccctctggccctccgggagttcaaagaatttgctgccggcagacgctctgtgagcggggatctgatcctggagattggaaagctcccccagcaccttacccagcgggcgcaaaatgccctggacaacctggttatgctccataattccgaacagggcgggagagcttatcggcacgccatggaggagctgcctgatacaatcgaaacccttatgctgctcgctctgattgccgtgctgacgggaggcgtgacactcttctttctttctggccgcgggctgggaaagaccagcatcggcctgctctgtgtcatggcctccagcgttctgctttggatggcttctgtggagccccattggattgcggcctccatcatcctggagttctttctcatggtgctgctgattccggagcctgacagacagcggacaccccaggataaccaactcgcttacgtcgtgatcgggcttctgttcatgattctgacagttgccgccaatgagatgggactcctggaaaccaccaaaaaggaccttggcatcgggcacgtggctgtcgagaaccaccatcacgccgcgatgctggatgtggacctccatcctgccagcgcttggacgctgtacgccgtcgctaccacaattatcacccccatgatgcgccacacaattgaaaacaccacggccaatatctctctgaccgcgatcgccaaccaggctgccattctcatgggacttgataaaggctggcctatctccaagatggacattggcgtgcccctgctggctctcgggtgctatagccaggttaatccgctgacacttaccgccgctgtgctgatgctcgtcgcccattacgcgatcattggacctggcctgcaagccaaagctacaagagaggcccagaagcggaccgctgccgggatcatgaagaaccccacggtggatggaatcgttgccattgacctggatcccgtggtctatgacgcgaaatttgaaaagcagctcggccagatcatgcttctgattctgtgtacatctcaaatcctcctgatgcgcaccacatgggctctttgcgagagcattaccctggccaccgggcctctcacaacgctgtgggagggatccccgggcaaattctggaataccacaatcgctgtgtctatggccaacatctttagaggcagctacctggccggggctggactcgccttctcccttatgaaaagcctgggcgggggacggcgcggcaccggggcgcagggagaaacactgggcgagaaatggaagagacagctcaatcagctgtccaagtctgagttcaacacctataaacggagcggcattatggaggtggacagatccgaagccaaggaggggcttaaacgcggagagacgacaaagcacgctgtttctcggggcaccgccaaactgagatggtttgtcgaacgcaatctcgtgaagcccgaggggaaggtgatcgatctgggatgtggcagagggggatggagctactattgcgctggcctgaaaaaggtcaccgaagttaaaggctacacaaaagggggacctggccacgaggaacccattcctatggccacctacgggtggaacctcgtgaaacttcattccggaaaggacgtgttctttattccccctgagaaatgtgatacactgctgtgcgacatcggcgagtctagcccgaatcccacgatcgaagaggggagaaccctccgcgtcctgaagatggtggaaccttggcttcggggaaaccaattctgtattaagatcctgaatccctatatgccttccgttgtggagacactcgagcagatgcagagaaaacacggcggcatgctggtccgcaaccccctgagcagaaattctacccatgaaatgtactgggtgtcctgcgggacaggaaacatcgttagcgcggtgaatatgacctctagaatgctcctgaaccgctttacgatggcccaccggaagccgacctatgagagagatgtcgaccttggcacagggacccgccacgtggctgtggaacctgaggtcgccaacctggatattatcggacagagaattgaaaatatcaaacatgagcacaagtccacatggcattacgacgaggataacccctataaaacctgggcttaccacggcagctatgaagttaagccctctgggtccgccagctccatggtgaatggagtggtcaagctcctgacaaaaccttgggacgtgattcccatggttacccaaatcgctatgacggatacaacccctttcggccagcagcgggtgtttaaggagaaagtcgacacccgcacaccgaaggccaaaagaggcacggcgcaaatcatggaagtgaccgcccggtggctttgggggttcctgagcagaaacaagaagccccggatttgtacacgcgaggaatttaccagaaaagttcggtctaatgctgccatcggagctgtgttcgtcgacgagaaccagtggaatagcgccaaggaggccgtggaagatgagcgcttttgggacctcgttcatagagaacgggagctgcacaaacagggcaagtgcgcgacatgcgtgtacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtcgagggggagggactccataaactgggctatatccttagagacatttctaagatccctgggggaaatatgtacgccgatgacaccgctggctgggatacacggatcaccgaagacgatctgcagaacgaggccaaaattacggacatcatggaacccgagcacgcgctcctggccaaggctattttcaaactgacctatcaaaataaggtggtccgcgtgcagagacctgccaagaacgggacagttatggatgtgatcagccggcgcgaccagagaggctccggacaggtcggcacctacgggctcaatacatttaccaacatggaagctcaactgattcggcagatggagtctgagggaatcttcagcccctccgaacttgagacgccgaacctggccgaaagagcgctcgattggctggagaaatatggcgtggaacgccttaagcggatggccatcagcggggacgactgtgtggttaaacctattgatgacagatttgctacagccctgaccgctctcaatgatatgggaaaggtgcgcaaagacatcccccagtgggagccttctaagggctggaacgattggcagcaagtccccttctgctcccatcactttcaccagctgattatgaaggacgggcgggagatcgtggttccttgtagaaatcaggatgaactggtgggccgcgcccgggtcagccagggagctggctggtctctcagagagacagcctgcctggggaaatcctacgcgcaaatgtggcagcttatgtatttccatcgccgggacctgagactcgccgctaacgccatttgtagcgccgtgcccgtcgattgggtgccgacctcccgcacgacctggtctatccacgctcatcaccagtggatgacaaccgaagacatgctgagcgtttggaatcgggtgtggattgaggaaaacccttggatggaggataagacacatatctccagctgggaggacgtcccctaccttggaaaaagagaagaccaatggtgcggctctctgatcgggctcaccgcccgggcgacatgggctaccaatattcaggtggccatcaaccaggttagacgcctgattggaaatgagaactacctggattatatgacgtccatgaagcggtttaaaaatgaaagcgaccccgagggcgccctctggtga

SEQ ID NO: 18560 - RNA, 9879 nt, synthetic construct
  misc_feature 1..9879: note = derived and/or modified CDS sequence (opt5) from DENV-1__JQ287664__SS-prME
  source 1..9879: mol_type = other RNA
agcgtgaccatgctgctcatgctgatgcccaccgctcttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagcgggtggaaacatgggccctgcgccaccccggcttcaccgtcatcgctctttttctggcccatgtgattgggacatctatcacccagaagggaatcattttcatcctcctgatgcttgttacccctagcatggcgatgagatgcgtgggcattgggtcccgggattttgtcgagggactgagcggcgccacatgggtggacgtggtcctcgagcacgggtcttgtgttacgaccatggctaaggataaacccacactggacatcgaactgctcaagaccgaggtgacaaaccctgccgtgctgcgcaaactttgcattgaagctaagatctccaataccacgacagatagcagatgtccgacccaaggagaggccaccctggtcgaagaacaggacgcgaacttcgtgtgccggcgcacatttgttgatagaggctggggcaatgggtgtggactcttcggcaaagggtctctgattacctgcgccaagtttaagtgcgtgacaaaacttgagggaaagatcgtccagtacgaaaacctgaaatattccgtgatcgttacggtgcacaccggcgaccagcatcaagtcgggaatgagagcacagaacacggaaccacagctaccattacgccccaggcccctacctctgagatccagctcacagactacggcgctctgaccctggattgtagcccccggacaggcctcgacttcaacgaaatggtgctgcttaccatgaaggagaaaagctggctggtccataagcagtggtttctcgatctgcctcttccctggacgtccggggcctctacaagccaagagacctggaatcgccaggacctgctcgtgacattcaaaaccgcccacgctaagaagcaggaagttgtggtcctgggatcccaagagggcgcgatgcacaccgccctgacaggggctacggaaattcagaccagcggaacaaccacaatctttgccggccatctcaaatgcagactgaagatggataaacttaccctgaaggggatgtcttatgtgatgtgtacgggctccttcaaactcgagaaggaagttgccgagacacagcacggaaccgtgctggtccagattaagtacgagggcaccgacgctccgtgcaaaatccctttcagcacacaagatgaaaagggggtgacccagaacggacggctgatcacagccaatcccattgtgacggacaaagagaagcctgttaacatcgaagcggagccgccctttggcgagtcttatattgtcatcggggctggagaaaaagcccttaagctcagctggttcaagaaaggctcctctattgggaagatgtttgaggccaccgctagaggcgcccgccggatggctatcctgggagatacagcctgggacttcggcagcatcgggggagtgtttacctccgtgggcaaactggtccatcagattttcgggacagcgtacggagtgctctttagcggcgtttcttggaccatgaagatcgggattggcgtgctgcttacgtggctgggactcaattccagaagcacctctctgtccatgacatgtatcgccgtcggcctggtgaccctttacctcggggttatggtgcaggctgatagcggatgcgtcattaactggaaaggccgcgaactgaagtgtgggtccggaatcttcgtgacaaatgaggttcacacctggacagaacaatataagtttcaggccgactctcctaaacggctgagcgctgccattggcaaggcgtgggaggagggggtgtgcggcatcagatccgccacccgcctcgaaaacatcatgtggcggcagatttctaacgagctgaatcatatccttctggaaaacgacatgaaattcacggtcgtggtgggagatgtcgttggcattctcgctcaggggaagaaaatgatcagaccgcaacccatggagcacaagtacagctggaaatcctggggaaaggccaagattatcggcgctgacgtgcagaatacaacctttatcattgatgggcctaacacccccgaatgtcctgacgatcagcgcgcctggaatatctgggaggtggaggactatggattcggcatttttacaaccaacatctggctgaaactgcgggatagctacacgcaggtctgcgaccacagacttatgtctgccgctattaaggattccaaagcggtgcatgccgacatgggctattggatcgaaagcgagaagaatgaaacatggaaactcgctcgcgcctctttcatcgaggttaagacctgtatttggcccaagtcccacacactgtggagcaacggggtgctggaatctgagatgatcattccgaaaatctacggaggccctattagccaacataattatcggcccgggtacttcacccagacagccggaccttggcacctcggcaagctggagcttgattttgacctgtgcgaagggaccacggtcgtggttgatgagcactgcggaaacagaggcccctccctccggaccacaaccgtgacaggcaaaatcatccatgaatggtgttgccgcagctgtaccctgcctcccctgagattcaagggggaggacggatgctggtacggcatggagattcggccggtcaaagaaaaggaggaaaatcttgtgaagtctatggtttccgctgggagcggagaggtggactccttttctctcggcctgctgtgtatcagcattatgatcgaagaggtcatgagatcccgctggtctcggaaaatgctcatgacggggacactggccgtgttctttcttctgattatgggacagctcacctggaacgatctgatcagactgtgcattatggtgggcgcgaatgctagcgaccgcatgggcatggggacaacctatcttgccctgatggccaccttcaagatgagacctatgtttgctgtcggactcctgttccggcgcctcacatccagagaggttctgcttctgacgatcggcctctctctggtggccagcgtggaactgcccaactcccttgaggaactgggggatggactcgcgatgggcatcatgattctgaaactcctgaccgactttcaaagctaccagctttgggctacactgctctctctgaccttcatcaagacaaccttttccctgcactatgcctggaaaacgatggccatggtccttagcattgtgtctctgctccccctgtgtctctccacaaccagccagaagaccacatggctgcctgttcttctggggtctctgggatgcaagccgctcaccatgttctttatcgctgagaataaaatttggggccggaagtcctggcccctgaacgaaggcatcatggccgtggggatcgtcagcattcttctgtccagcctcctgaaaaacgatgtgcctctcgctggacccctgatcgccggcgggatgcttattgcgtgttacgttatctctggaagctccgccgacctgtctctggagaaggctgccgaggtgagctgggaagaggaagctgagcattccggcgcctctcacaatattctcgtcgaagtgcaggatgacgggacaatgaaaatcaaggatgaggagcgcgacgatacgctgaccatccttctgaaagccacactcctggctgtcagcggagtgtatcctctctccattcccgcgaccctgttcgtttggtacttctggcaaaagaagaaacagagatctggcgtgctttgggacacaccttcccctcccgaagtcgagcgggccgtgctggatgacggcatctatcgcattatgcagagagggctgctcggacggtcccaggttggcgtgggggtctttcaagaaaacgtgttccataccatgtggcacgtgacgcgcggagctgttctgatgtaccagggcaagagacttgagcccagctgggcctctgtcaaaaaggacctgatctcctacgggggaggctggcggctccagggcagctggaataccggggaggaagtccaggtgattgccgtcgagcccggcaagaatcctaagaatgtgcaaacagctcccggcacctttaagacaccggaaggggaggttggagccatcgcgctggatttcaaacctggcacctctgggtcccccattgtgaacagagaaggaaagatcgtcggcctctatggcaatggggtggttacaacgagcggaacctacgtgtccgctatcgcccaggccaaggcttctcaggagggccctctgcccgagattgaagacgaggtctttcgcaagcggaaccttacaatcatggatctgcaccccgggagcggaaaaaccagaaagtatctgcctgccattgtgcgcgaagcgatcaagcggaaactcagaaccctgattcttgctccgacacgcgttgtggcctccgagatggccgaagctctgaagggcatgcccatccggtaccaaacgaccgccgtcaaaagcgagcatacagggagagagatcgtggacctcatgtgccacgctaccttcacaatgcgcctgctgtctcctgtgcgggtccccaattataacatgattatcatggatgaagcccattttaccgacccttccagcattgcggccagaggctacatctctacgcgggttggaatgggcgaggctgccgctattttcatgacagccacaccccctgggagcgtggaagcctttccgcagtccaatgctgtgatccaggatgaggaacgcgacatccccgagagatcttggaacagcggatatgagtggattaccgatttccctggcaagacagtctggtttgtgccctccatcaaatctgggaatgacattgcgaactgtctccggaagaatggaaagcgcgttatccagcttagcagaaaaaccttcgatacagaataccaaaagaccaaaaacaacgactgggactacgtggtcacgacagatatttccgagatgggcgccaatttccgggctgacagagtgatcgatcctcgccggtgcctgaagcccgttattctgaaagacgggccggaaagagtgatcctcgccggccctatgcccgtcaccgtggccagcgctgcccagcgccggggaagaatcggccgcaaccacaataaggagggggatcagtatatttacatgggacagcccctgaacaatgacgaggatcatgcgcactggacagaagctaagatgcttctggacaacatcaatacccctgagggcattatccccgccctctttgaacctgagcgggaaaaatctgccgctattgatggggagtatagactgcgcggagaggccagaaagacgttcgtcgaactgatgcggcgcggcgacctcccggtgtggctttcctacaaagttgcgagcgaggggtttcaatattccgatagacggtggtgcttcgacggcgaacgcaacaatcaggtgctggaggaaaacatggatgtggagatctggaccaaggagggagaacgcaagaaactgcggcccagatggctcgacgcccgcacatactctgaccctctggcccttcgggagtttaaagagttcgccgctggcagacgcagcatctccggggatctgattctcgagatcggaaaactgccccagcacctgacccagcgggcccaaaatgctctcgacaaccttgtcatgctgcataattctgaacagggcgggagagcctatcggcacgcgatggaggagctgcctgatacaattgaaaccctcatgctgcttgccctgatcgctgttctcacaggaggcgtgaccctgtttttcctgagcggccgcgggctcggaaagacgtccattggccttctgtgtgtgatggccagctctgctctgctctggatggcctccgtcgagccccattggatcgccgctagcatcattctggaatttttccttatggtgctgctcatcccggagcctgacagacagcggacaccccaggataaccaactggcgtacgttgtgattgggctgctctttatgatccttaccgtcgccgctaatgagatgggactgctggaaaccaccaaaaaggacctcggcattgggcacgtggccgtcgagaaccaccatcacgccaccatgctggatgtggaccttcatcctgcttctgcctggacactgtacgcggttgccacgaccatcattacacccatgatgcgccacaccatcgaaaacacaaccgctaatatctccctcacggccattgctaaccaggccgcgatcctgatgggactggataaaggctggcctattagcaagatggacatcggcgtgcccctccttgccctggggtgctattctcaggtcaatccgctgaccctcacagctgccgtgctgatgcttgttgctcattacgccattatcggacctggcctgcaagctaaagccaccagagaggcgcagaagcggacagccgctgggatcatgaagaaccccaccgtggatggaattgtcgccatcgacctcgatcccgtggtgtatgacgctaaattcgaaaagcagctgggccagattatgctgctcatcctttgtacgagccaaattctgctgatgcgcacaacctgggccctctgcgagtccatcacactggccaccgggcctcttaccacactgtgggagggatctccgggcaaattttggaatacgaccatcgcggttagcatggctaacattttcagaggctcctacctcgccggggctggactggccttcagcctgatgaagtccctcggcgggggacggcgcggcacaggggcccagggagaaacccttggcgagaaatggaagagacagctgaatcagctgtctaagagcgaatttaacacatataaacggtccggcatcctcgaggtcgacagatctgaagctaaggaggggctgcgccggggagagaccacgaaacacgccgtgagcagaggcacagcgaaacttcgctggttcgtggaacggaatctggtcaaacccgaggggaaggttattgatctcggatgtggcagagggggatggtcctactattgcgccggcctgaagaaagtgaccgaagtgaagggctacaccaaagggggacctggccacgaggaacccatccctatggctacatacgggtggaacctggtcaagctccattctggaaaagacgtgtttttcattccccctgagaagtgtgatacccttctgtgcgacatcggcgagagctccccgaatcccacaattgaagaggggcgcacgctgcgggttctcaaaatggtggaaccttggctgagaggaaaccaattttgtatcaagatccttaatccctatatgcctagcgtcgtggagaccctggagcagatgcagcgcaagcacggcggcatgctcgttcggaaccccctgtctagaaattccacacatgaaatgtactgggtgagctgcgggaccggaaacattgtctctgccgtgaatatgacatcccgcatgctgctcaaccggttcaccatggctcacagaaaaccgacgtatgagcgcgatgtggacctgggcgccgggaccagacacgtcgcggttgaacctgaggtggccaaccttgatatcattggacagcggatcgaaaatattaagcatgagcacaaaagcacatggcattacgacgaggataacccctataagacctgggcttaccacggctcttatgaagtgaaaccctccgggagcgcctccagcatggtcaatggagtggttaagctgctcacaaagccttgggacgtgatccccatggtcacccaaatcgctatgacagataccacgccttttggccagcagcgcgtgttcaaagagaaggttgacacaagaaccccgaaagccaagcggggcaccgctcaaattatggaagtgacagccagatggctgtgggggtttctttctcggaacaaaaagccccgcatctgtacgagagaggagttcacccggaaggtccgcagcaatgcggccattggagctgtgtttgttgacgagaaccagtggaactccgccaaagaggctgtggaagatgagagattctgggacctggtccatcgggaacgcgagctccacaagcagggcaaatgcgccacatgcgtgtacaacatgatggggaagagagagaaaaagctgggagagtttggcaaggccaaagggtctcgggcgatctggtacatgtggctgggcgctcgcttcctcgagttcgaagccctgggatttatgaatgaggatcactggttcagcagagaaaactccctttctggcgtcgagggggagggactgcataagctcggctatattctgcgggacatcagcaaaatccctgggggaaatatgtacgccgatgacaccgctggctgggatacacgcattaccgaagacgatcttcagaacgaggccaagatcacagacattatggaacccgagcacgctctgctcgccacctccatctttaaactgacgtatcaaaataaggtggttagagtgcagcggcctgcgaaaaacgggaccgtcatggatgtgatttctcgcagagaccagcggggcagcggacaggtgggcacatacgggctgaataccttcacaaacatggaagcccaactcatcagacagatggagtccgagggaatctttagcccctctgaactggagaccccgaaccttgctgaacgcgttctggattggctcgagaagtatggcgtggaacggctgaagagaatggccatttccggggacgactgtgtcgtgaaacctatcgatgaccgcttcgctacggcccttacagcgctgaatgatatgggaaaggttcggaaagacattccccagtgggagcctagcaagggctggaacgattggcagcaagtgcccttttgctctcatcacttccaccagctcatcatgaaagacgggagagagattgtcgtgccttgtcgcaatcaggatgaactggtcggccgggccagagtgtcccagggagctggctggagcctgcgcgagaccgcctgcctcgggaagtcctacgctcaaatgtggcagctgatgtattttcatcggagagaccttcgcctggccgctaacgccatctgttctgcggttcccttcgattgggtgccgacaagccggaccacgtggtccattcacgcccatcaccagtggatgaccacagaagacatgctcagcgtctggaatagagtgtggatcgaggaaaacccttggatggaggataagacccatatctcttcctgggaggacgttccctacctgggaaaacgggaagaccaatggtgcggcagccttattgggctgacagctagagccacctgggccacaaatatccaggtggctattaaccaggtccgccggctcatcggaaatgagaactacctggattatatgacctctatgaagagatttaaaaatgaaagcgacacggagggcgccctgtggtga

SEQ ID NO: 18561 - RNA, 9879 nt, synthetic construct
  misc_feature 1..9879: note = derived and/or modified CDS sequence (opt5) from DENV-1__FJ639683__SS-prME
  source 1..9879: mol_type = other RNA
agcgtgaccatgctgctcatgctgatgcccaccgcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccaccagcttctctatgacctgtattgccgtgggcctggttacactgtaccttggggtgatggtccaggctgattccggatgcgtgatcaactggaaaggccgcgaactcaagtgtgggagcggaatttttgttaccaatgaggtgcacacatggaccgaacaatataagttccaggccgactcccctaaacggctgtctgcggccatcggcaaggcttgggaggagggggtctgcggcatcagaagcgccacgcgcctggaaaacattatgtggaaacagatctccaacgagctcaatcatattctgcttgaaaacgacatgaagtttacagtggttgtgggagatgtcgctggcatcctggcccaggggaaaaagatgattcggccgcaacccatggagtacaaatattcttggaaaagctggggaaaggccaagatcatcggcgctgacgtgcagaataccaccttcattatcgatgggcctaacacacccgaatgtcctgacgatcagagagcgtggaatatttgggaggtggaggactacggatttggcatcttcaccacgaacatttggctcaagctgcgcgattcctatacacaggtctgcgaccaccggctgatgagcgccgctatcaaagattctaaggccgttcacgccgacatgggctactggatcgaatccgagaaaaatgaaacctggaaacttgctagagccagcttcattgaggtgaagacatgtatctggcccaagtctcataccctctggtccaacggggtgctggaaagcgagatgattatcccgaagatttatggaggccctatctctcaacacaattaccgccccgggtactttacacagaccgcgggaccttggcatctgggcaaactcgagctggatttcgacctttgcgaagggacgaccgtcgtggttgatgagcactgcggaaaccggggccccagcctgagaacaaccacagtgaccggcaagatcattcacgaatggtgttgccggtcctgtacgctccctcccctgcgctttagaggggaggacggatgctggtatggcatggagatccggccggtcaaagaaaaggaggaaaatctggtcaagagccttgtttctgctgggtccggagaggtggacagcttctccctcggcctgctgtgtatttctatcatgattgaagaggtcatgagaagccgctggtcccggaaaatgctcatgacagggaccctggccgtgtttcttctgctcatcatgggacagctgacatggaacgatctgattagactttgcatcatggttggcgccaatgcttctgaccgcatgggcatggggaccacctacctggccctcatggcgacattcaagatgagacctatgtttgctgtgggactcctgttccggcgcctgacgagcagagaggtccttctgctcaccatcggcctgtccctggtggcctctgtggaacttcccaacagcctggaggaactcggggatggactggccatgggcattatgatcctcaaactgcttacagactttcaatcccatcagctgtgggctaccctcctgagcctgacattcattaagaccacgttttctcttcactatgcctggaaaacaatggctatggtcctgtccatcgttagcctcttccccctgtgtctctctaccacctcccagaagacaacctggctgcctgtgcttctggggagcctgggatgcaagccgctcacaatgtttctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacacttttcgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtctttcaagaaaacgtgttccatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacatttaagaccccggaaggggaggtgggagccattgccctcgatttcaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtctttcggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacattcaccatgcggctgctcagccctgttagagtgcccaattataacatgatcattatggatgaagctcattttacggacccttcttccatcgccgctcggggctacattagcacacgcgtcggaatgggcgaggccgccgctatcttcatgaccgcgacaccccctgggtctgtggaagcctttccgcagagcaatgctgtgatccaggatgaggaaagagacattcccgagcggtcctggaactctggacacgagtggatcacagatttccctggcaaaaccgtctggtttgttcccagcattaagtccgggaatgacatcgccaactgtcttcgcaaaaatggaaagagagtgattcagctgtctcggaagacattcgataccgaatatcagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccataataaagagggggatcagtacatctatatgggacagccccttaacaatgacgaggatcacgcccactggaccgaagctaagatgctgctcgacaacattaatacgcctgagggcatcattcccgccctgtttgaacctgagagagaaaagagcgcggccatcgatggggagtaccgcctgagaggagaggctcggaaaaccttcgttgaactcatgcgcagaggcgaccttccggtgtggctgtcttataaggtcgcctccgaggggtttcaatacagcgatcggcgctggtgcttcgacggcgaaagaaacaatcaggtgctggaggaaaacatggatgtcgagatctggacaaaagagggagaacggaagaaactcagaccccgctggctggacgctcggacctattccgaccctcttgccctgagagagtttaaggagttcgctgccggccgccggtctgtgagcggggatctcattctggagatcggaaaactgccccagcatctcacacagagagcgcaaaatgcccttgacaacctggttatgctgcacaattccgaacagggcgggcgggcttaccgccatgccatggaggagctccctgataccattgaaacactgatgcttctggctctcatcgccgtgctgaccggaggcgtgacgctgtttttcctctctggcagagggcttggaaagacaagcattggcctgctgtgtgtcatggcctccagcgttctcctgtggatggcttctgtggagccccactggatcgcggcctccatcattcttgaatttttcctgatggtgctcctgatcccggagcctgaccggcagcgcacaccccaggataaccaactggcttatgtcgtgattgggctcctttttatgatcctgaccgttgccgccaatgagatgggactgctcgaaacaaccaagaaagacctgggcattgggcacgtggctgtcggaaaccatcaccatgccgcgatgcttgatgtggacctgcaccctgccagcgcttggacactctacgccgtcgctacgaccatcattacacccatgatgagacataccatcgagaacacaaccgccaatatctctctgacggcgattgccaaccaggctgccatcctgatgggcctcgataagggctggcctatttccaaaatggacatcggggtgccccttctggctctgggatgctacagccaggttaatccgctcaccctgacagccgctgtgcttatgctggtcgcccactatgcgattatcggccctgggctccaagccaaggctacccgggaagcccagaaacgcacagctgccggaatcatgaagaaccccaccgtggatggcattgttgccatcgacctggatcccgtggtctacgacgcgaagttcgagaaacagctggggcagattatgctccttatcctgtgtacgtctcaaattctgctcatgagaacaacctgggctctgtgcgaaagcatcacacttgccaccggacctctgaccacactctgggagggctccccgggcaagttttggaatacgaccatcgctgtgtctatggccaacattttccgggggagctatctggccggagctggcctggccttctccctcatgaaaagccttgggggaggccgcagagggacaggagcgcagggcgagaccctgggcgaaaagtggaaacggcagctgaatcagctctccaagtctgagtttaacacatacaagagaagcgggatcatggaagtggaccgctccgaggccaaagaaggactgaagcggggcgagaccacgaaacacgctgtttctagagggacagccaaacttcgctggttcgtcgagcggaatctggtgaaacccgaaggaaaggtgattgatctcggctgtgggagaggaggctggagctattactgcgctggcctgaagaaagtcaccgaggttaaggggtataccaaaggaggccctgggcatgaggaacccatccctatggccacatacggatggaacctggtgaagctccactccggcaaagacgtgtttttcgtgccccctgaaaagtgtgatacccttctgtgcgacattggggagtctagcccgaatcccacaatcgaggaaggacgcacgctgcgggtgctcaaaatggttgagccttggctgagaggcaaccaattttgtattaagatccttaatccctacatgccttccgtggtcgaaaccctggagcagatgcagcgcaagcatggcgggatgctcgtgcggaaccccctgagcagaaattctacacacgagatgtattgggtttcctgcggaaccggcaacatcgtgagcgcggtcaatatgacatctcgcatgctgctcaaccggttcaccatggcccacagaaaaccgacgtacgaacgcgatgtggacctgggggctggaaccagacatgtggccgtcgagcctgaagttgctaaccttgatattatcggccagcggattgagaatatcaagcacgaacataaatccacatggcactatgacgaggataacccctacaagacctgggcctatcatgggagctacgaggtgaaaccctctggatccgctagctccatggtgaatggcgtcgtgaagctgctcacaaagccttgggacgttattcccatggtgacccaaatcgccatgacagataccacgccttttggccagcagcgcgtcttcaaagaaaaggtggacacaagaaccccgaaagcgaagcgggggaccgcccaaatcatggaggttacagctaaatggctgtggggatttcttagcagaaacaagaagccccggatttgtacgcgcgaagagttcaccagaaaagtgcggtctaatgccgctatcggcgccgtctttgtggacgaaaaccagtggaatagcgccaaggaggcggttgaggatgaacgcttctgggacctggtgcacagagagcgggaactccacaaacaggggaagtgcgctacatgcgtctataacatgatgggaaaacgcgagaagaagctgggcgaatttgggaaagccaagggctccagagccatttggtacatgtggctgggagctcggttcctcgagttcgaggccctgggctttatgaatgaagatcattggttctctcgcgagaacagcctttccggggtggaaggagagggcctgcacaaactcgggtacatcctgagagacatttctaagatccctggaggcaatatgtatgctgatgacaccgccgggtgggatacacggatcaccgaggacgatcttcagaacgaagcgcgcattacagacatcatggagcccgaacatgccctgctcgctaaaagcatttttaagctgacctaccaaaataaagtcgtgagagttcagcggcctgccaagaacggcacggtgatggatgtcatctcccgcagagaccagcggggatctggccaggtggggacctatggactgaatacattcaccaacatggaggctcaactcattagacagatggaaagcgagggcatcttttcccccagcgagctggaaacaccgaaccttgccgagcgcgtgctggattggctcgaaaagtacggggttgagcggctgaaaagaatggcgatctctggagacgactgtgtggtcaagcctattgatgaccgcttcgccaccgctcttacggccctgaatgatatgggcaaagtgcggaaggacatcccccagtgggaaccttccaaagggtggaacgattggcagcaagttcccttttgcagccaccacttccatcagctcattatgaaggacggcagagagatcgtggtcccttgtcgcaatcaggatgagctggtgggacgggctagagtctctcagggcgccgggtggtccctgcgcgaaacagcttgcctcggaaagagctatgcccaaatgtggcagctgatgtactttcaccggagagaccttcgcctggcggccaacgctatttgttccgccgtgcccgttgattggatcccgacctctcggacaacctggagcattcatgcccaccatcagtggatgacgaccgaggacatgctctccgtgtggaatagagtctggatcgaagagaacccttggatggaagataaaacacacatcagctcttggggcgacgtgccctatctggggaagcgggaggaccaatggtgcggatcccttattggcctgaccgctagagccacatgggcgaccaatatccaggttgctattaaccaggtgcgccggctcatcgggaatgagaactacctggattacatgacaagcatgaaaagattcaagaatgaatctgaccccgagggcgccctgtggtga

SEQ ID NO: 18562 - RNA, 9879 nt, synthetic construct
  misc_feature 1..9879: note = derived and/or modified CDS sequence (opt5) from DENV-1__FJ639684__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgtggaagccttccctcagagcaatgctgtcatccaggatgaggaacgggacatcccggagcgctcctggaactctggatatgagtggattacagattttcccggcaaaaccgtttggttcgtgcctagcatcaagtccgggaatgacattgccaactgtctgagaaagaatggaaaacgggtgatccagctcagccgcaagaccttcgatacagaataccagaagaccaagaacaacgactgggactacgtcgtgacaaccgatatttctgagatgggcgccaattttagagctgaccgggttatcgatcccagacgctgccttaaacctgtgattctgaaggacgggcccgaacgggtcatcctggccggcccgatgcctgtgacggttgcgtccgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagagcgcggccattgatggggagtatcggctcagaggagaggctcgcaaaacatttgtggaactgatgagacggggcgacctgcctgtctggctctcctacaaggtggcctctgaggggttccaatatagcgatcgcagatggtgctttgacggcgaacggaacaatcaggtccttgaggaaaacatggatgtggagatctggaccaaagagggagaacgcaagaaactgagaccgcggtggctggacgctagaacgtactccgaccccctcgccctgcgcgagttcaaggaatttgctgccggccggagatctgttagcggggatcttatcctggagattggaaagctccctcagcacctgacccagcgcgcgcaaaatgccctggacaacctcgtgatgcttcataattccgaacagggcgggcgggcttatagacacgccatggaggagctgcccgatacaatcgaaaccctgatgctcctggctcttattgccgtgctgacaggaggcgtcaccctcttctttctgagcggccgggggctgggaaaaacatctatcggcctcctttgtgttatggcctccagcgtgctgctgtggatggcttctgtggagcctcattggattgcggcctccatcatcctcgagttctttctgatggtccttctgattcccgagccggaccgccagagaacccctcaggataaccaactcgcttacgtggttatcgggctgctgttcatgattctcacggtggccgccaatgagatgggacttctggaaacaaccaagaaagacctgggcatcgggcacgtcgctgtggagaaccaccatcacgccgcgatgctcgatgtcgacctgcatcccgccagcgcttggaccctttacgccgtggctacaaccattatcacacctatgatgcggcacacgattgaaaacaccacagccaatatctctctgaccgcgatcgccaaccaggctgccattctcatgggactggataagggctggcccatcagcaaaatggacattggcgttcctctgctcgctcttgggtgctattcccaggtgaatcccctgacactgaccgccgctgtcctcatgctggtggcccattacgcgatcattggaccgggccttcaagccaaggctacgcgcgaggcccagaagagaaccgctgccgggatcatgaaaaaccctacagttgatggaatcgtggccattgacctggatcccgtcgtgtatgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgtgagcatggccaacatcttccgcggctcctacctggccggggctggactcgccttttctctgatgaaaagcctgggcgggggaagacggggcacaggggcgcagggagaaacgctcggcgagaagtggaagcgccagcttaatcagctgtccaaatctgagttcaacacctataagagaagcggcattatggaggttgaccggtccgaagccaaagaggggctgaagagaggagagacaaccaaacacgctgtctctcgcggcacagccaagctccggtggtttgtggaaagaaatctggtgaagccggaggggaaagtcatcgatcttggatgtggccgcgggggatggagctactattgcgctggcctgaagaaagttaccgaagtgaagggctacacgaaagggggacccggccacgaggaacctattcccatggccacatacgggtggaacctcgtgaagctgcattccggaaaagacgtcttctttgtgcctcccgagaagtgtgataccctgctctgcgacatcggcgagagctctcctaatccgaccattgaagaggggcggacacttagagttctgaagatggtggaaccctggctgcgcggaaaccaattctgtatcaaaattctcaatccttatatgccctccgtcgtggagaccctggagcagatgcagcggaagcacggcggcatgcttgttagaaaccctctgagccgcaattctacacatgaaatgtactgggtgtcctgcgggacgggaaacatcgtcagcgcggtgaatatgacctctcggatgctcctgaacagatttacaatggcccaccgcaaacccacctatgagcgggatgtggacctgggcgctgggacaagacacgtcgccgttgaaccggaggtggctaacctcgatatcattggacagcgcatcgaaaatattaagcatgagcacaaatccacctggcattacgacgaggataacccttataagacgtgggcctaccacggcagctatgaagtgaagccctccgggagcgcttctagcatggtcaatggagtggttaaactgcttaccaagccctgggacgtgatccctatggtcacacaaattgccatgaccgatacaacccccttcggccagcagagagtgtttaaagagaaggttgacacacggacccctaaagcgaagcgcggcacggcccaaatcatggaagtgacagctaagtggctgtgggggttcctctccagaaacaaaaagccgcggatctgtaccagagaggaatttacccggaaagtccgctctaatgccgctattggagccgtgttcgttgacgagaaccagtggaatagcgccaaggaggcggtggaagatgagagattttgggacctggtccatcgggaacgcgagcttcacaaacagggcaagtgcgctacatgcgtgtacaacatgatggggaagagagagaagaagctgggagagttcggcaaagccaaggggtcccgggccatctggtacatgtggctcggcgctcgcttcctggagtttgaagccctgggattcatgaatgaggatcactggttttctagagaaaacagcctctccggcgtcgagggggagggactgcataaacttggctatattctgcgggacatctctaagattagcgggggaaatatgtacgctgatgacacggccggctgggatacccgcatcacagaagacgatctccagaacgaggcgaaaatcaccgacattatggaacccgagcacgccctgcttgctaagtccatcttcaagctgacatatcaaaataaagtggttagagtgcagcggcctgccaagaacgggaccgtcatggatgtgattagccgcagagaccagcggggctctggacaggtgggcacatacgggctcaatacctttacgaacatggaagctcaactgatccgccagatggagtccgagggaattttcagcccctctgaactggagacccctaacctcgccgaaagagcgctggattggcttgagaaacatggcgttgaacggctgaagagaatggccatctccggggacgactgtgtggtcaaacccatcgatgaccgctttgctacagccctcaccgctctgaatgatatgggaaaggtgcggaaggacattccgcagtgggagcctagcaaaggctggaacgattggcagcaagttcccttctgctcccaccactttcatcagcttatcatgaaggacgggagagagattgtggtcccttgtcgcaatcaggatgaactggtgggccgggccagagtctctcagggagctggctggagcctccgcgagacagcctgcctggggaaatcctatgcgcaaatgtggcagctgatgtacttccaccggagagacctccgcctggccgctaacgccatctgtagcgccgtgcccgttgattgggtgcctacctctcggacgacatggtccattcatgctcaccatcagtggatgaccacagaagacatgcttagcgtctggaatagagtgtggatcgaggaaaacccctggatggaggataagacccacatttctagctgggaggacgttccgtatctgggaaaacgcgaagaccaatggtgcggctccctcatcgggctgacggcccgggcgacctgggctacaaatatccaggtggccattaaccaggtcagacggcttatcggaaatgagaactacctggattacatgacctctatgaagagatttaagaatgaaagcgtgcctgagggcgccctctggtga

SEQ ID NO: 18563 - RNA, 9879 nt, synthetic construct
  misc_feature 1..9879: note = derived and/or modified CDS sequence (opt5) from DENV-1__FJ639685__SS-prME
  source 1..9879: mol_type = other RNA
agcgtgaccatgctgctgatgctgatgcccaccgcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccaccagcttctctatgacctgtattgccgtgggcctggttacactgtaccttggggtgatggtccaggctgattccggatgcgtgatcaactggaaaggccgcgaactcaagtgtgggagcggaatttttgttaccaatgaggtgcacacatggaccgaacaatataagttccaggccgactcccctaaacggctgtctgcggccatcggcaaggcttgggaggagggggtctgcggcatcagaagcgccacgcgcctggaaaacattatgtggaaacagatctccaacgagctcaatcatattctgcttgaaaacgacatgaagtttacagtggttgtgggagatgtcgctggcatcctggcccaggggaaaaagatgattcggccgcaacccatggagtacaaatattcttggaaaagctggggaaaggccaagatcatcggcgctgacgtgcagaataccaccttcattatcgatgggcctaacacacccgaatgtcctgacgatcagagagcgtggaatatttgggaggtggaggactacggatttggcatcttcaccacgaacatttggctcaagctgcgcgattcctatacacaggtctgcgaccaccggctgatgagcgccgctatcaaagattctaaggccgttcacgccgacatgggctactggatcgaatccgagaaaaatgaaacctggaaacttgctagagccagcttcattgaggtgaagacatgtatctggcccaagtctcataccctctggtccaacggggtgctggaaagcgagatgattatcccgaagatttatggaggccctatctctcaacacaattaccgccccgggtactttacacagaccgcgggaccttggcatctgggcaaactcgagctggatttcgacctttgcgaagggacgaccgtcgtggttgatgagcactgcggaaaccggggccccagcctgagaacaaccacagtgaccggcaagatcattcacgaatggtgttgccggtcctgtacgctccctcccctgcgctttagaggggaggacggatgctggtatggcatggagatccggccggtcaaagaaaaggaggaaaatctggtcaagagcatggtttctgctgggtccggagaggtggacagcttctcccttggcctcctgtgtatttctatcatgattgaagaggtcatgagaagccgctggtcccggaaaatgctgatgacagggaccctcgccgtgtttctgcttctgatcatgggacagctcacatggaacgatctgattagactgtgcatcatggttggcgccaatgcttctgaccgcatgggcatggggaccacctaccttgccctgatggcgacattcaagatgagacctatgtttgctgtgggactcctgttccggcgcctcacgagcagagaggtcctgcttctgaccatcggcctctccctggtggcctctgtggaactgcccaacagccttgaggaactgggggatggactcgccatgggcattatgatcctgaaactcctgacagactttcaatcccatcagctttgggctaccctgctcagcctgacattcattaagaccacgttttctctgcactatgcctggaaaacaatggctatggtcctttccatcgttagcctgttccccctctgtctgtctaccacctcccagaagacaacctggctccctgtgctgcttgggagcctgggatgcaagccgctgacaatgtttctcattgccgagaataaaatctggggccggcgctcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaagccgccgaggtgtcttgggaagaggaagctgagcatagcggcgcgtcccacaatatcctcgtcgaagtgcaggatgacgggacgatgaagatcaaagatgaggagagagacgataccctgacaattcttctgaaggccaccctcctggctgtttctggagtgtatcctctcagcatccccgccacactgttcgtctggtacttctggcagaaaaagaagcagcggtccggcgtgctttgggacaccccttctcccccggaagtcgagcgcgccgtgctggatgacggcatttatagaatcatgcagcgggggctgctcggacgcagccaggttggcgtgggggtctttcaagaaaacgtgttccatacgatgtggcacgttaccagaggagctgtgctgatgtaccagggcaaacggcttgagccttcctgggccagcgtcaagaaagacctgatttcttacgggggaggctggagactccagggctcctggaatacaggggaggaagtgcaagtgatcgcggttgagcccggaaagaaccctaaaaatgtccaaaccgctcccggcacatttaagaccccggaaggggaggtgggagccattgccctggatttcaagcctggcacaagcgggtctcccatcgtgaaccgcgaaggaaaaatcgtcggcctctatggcaatggggtggttacgacctccggaacatacgtgagcgctattgcccaggcgaaggcttcccaggagggccctctgcccgagatcgaagacgaggtctttcggaaaagaaaccttaccattatggatctgcaccccgggtctggaaagacccgccggtatctgcctgccatcgtgagagaagccattaaacgcaagctccggacactgatccttgctccgacgagagttgtggccagcgagatggctgaagccctgaagggcatgcccatccgctaccaaaccacagcggtcaaatccgagcataccgggaaggagattgtggacctcatgtgccacgccacattcaccatgcggctgctgagccctgttagagtgcccaattataacatgatcattatggatgaagctcattttacggacccttcttccatcgccgctcggggctacattagcacacgcgtcggaatgggcgaggccgccgctatcttcatgaccgcgacaccccctgggtctgtggaagcctttccgcagagcaatgctgtgatccaggatgaggaaagagacattcccgagcggtcctggaactctggatatgagtggatcacagatttccctggcaaaaccgtctggtttgttcccagcattaagtccgggaatgacatcgccaactgtctccgcaaaaatggaaagagagtgattcagctttctcggaagacattcgataccgaataccagaaaacgaagaacaacgactgggactacgtggtcacaaccgatatcagcgagatgggcgccaatttcagagctgaccgcgtgattgatcctcggagatgcctgaaacccgttatcctgaaggacgggccggaacgcgtgatcctcgccggccctatgcccgtcacagtggcgtccgctgcccagcggagaggacgcattggccggaaccacaataaagagggggatcagtatatctacatgggacagcccctgaacaatgacgaggatcatgcccactggaccgaagctaagatgcttctggacaacattaatacgcctgagggcatcattcccgccctctttgaacctgagagagaaaagagcgcggccatcgatggggagtatcgcctgagaggagaggctcggaaaaccttcgttgaactgatgcgcagaggcgacctcccggtgtggctttcttacaaggtcgcctccgaggggtttcaatatagcgatcggcgctggtgcttcgacggcgaaagaaacaatcaggtgctggaggaaaacatggatgtcgagatctggacaaaagagggagaacggaagaaactgagaccccgctggctcgacgctcggacctactccgaccctctggcccttagagagtttaaggagttcgctgccggccgccggtctgtgagcggggatctgattctcgagatcggaaaactgccccagcacctgacacagagagcgcaaaatgccctcgacaaccttgttatgctgcataattccgaacagggcgggcgggcttatcgccacgccatggaggagctgcctgataccattgaaacactcatgctgcttgctctgatcgccgtgctcaccggaggcgtgacgctgtttttcctgtctggcagagggctcggaaagacaagcattggccttctgtgtgtcatggcctccagcgttctgctctggatggcttctgtggagccccattggatcgcggcctccatcattctggaatttttccttatggtgctgctcatcccggagcctgaccggcagcgcacaccccaggataaccaactggcttacgtcgtgattgggctgctctttatgatccttaccgttgccgccaatgagatgggactgctggaaacaaccaagaaagacctcggcattgggcacgtggctgccggaaaccaccatcacgcggccatgctggatgtcgaccttcatcctgctagcgcctggacactgtacgctgtggccacgaccatcattacacccatgatgagacacaccatcgagaacacaaccgcgaatatctctctcacggccattgctaaccaggccgctatcctgatgggcctggataagggctggcctatttccaaaatggacatcggggtccccctccttgccctgggatgctatagccaggtgaatccgctgaccctcacagctgccgttctgatgcttgtggcgcattacgccattatcggccctgggctgcaagctaaggccacccgggaagctcagaaacgcacagccgccggaatcatgaagaaccccaccgtcgatggcattgtggcgatcgacctcgatcccgttgtgtatgacgctaagttcgagaaacagctggggcagattatgctgctcatcctttgtacgtctcaaattctgctgatgagaacaacctgggccctctgcgaaagcatcacactggctaccggacctcttaccacactgtgggagggctccccgggcaagttttggaatacgaccatcgccgtctctatggccaacattttccgggggagctacctcgctggagccggcctggcgttctccgtgatgaaaagcctcgggggaggccgcagagggacaggagcccagggcgagaccctcggcgaaaagtggaaacggcagcttaatcagctgtccaagtctgagtttaacacatataagagaagcgggatcatggaagtggaccgctccgaggctaaagaaggactgaagcggggcgagaccacgaaacacgccgtttctagagggacagctaagctccgctggttcgtcgagcggaatctggtgaaacccgaaggaaaggtgattgatcttggctgtgggagaggaggctggagctactattgcgccggcctgaagaaagtcaccgaggttaaggggtacaccaaaggaggccctgggcacgaggaacccatccctatggcgacatacggatggaacctcgtgaagctgcattccggcaaagacgtgtttttcgtgccccctgaaaagtgtgataccctgctctgcgacattggggagtctagcccgaatcccacaatcgaggaaggacgcacgcttcgggtgctgaaaatggttgagccttggctgagaggcaaccaattttgtattaagatcctcaatccctatatgccttccgtggtcgaaaccctggagcagatgcagcgcaagcacggcgggatgcttgtgcggaaccccctgagcagaaattctacacatgagatgtactgggtttcctgcggaaccggcaacatcgtgagcgccgtcaatatgacatctcgcatgctcctgaaccggttcaccatggctcacagaaaaccgacgtatgaacgcgatgtggacctgggggccggaaccagacacgtggctgtcgagcctgaagttgccaacctcgatattatcggccagcggattgagaatatcaagcatgaacacaaatccacatggcattacgacgaggataacccctataagacctgggcttaccacgggagctatgaggtgaaaccctctggatccgccagctccatggtgaatggcgtcgtgaagctgcttacaaagccttgggacgttattcccatggtgacccaaatcgcgatgacagataccacgccttttggccagcagcgcgtcttcaaagaaaaggtggacacaagaaccccgaaagccaagcgggggaccgctcaaatcatggaggttacagccaaatggctgtggggatttctcagcagaaacaagaagccccggatttgtacgcgcgaagagttcaccagaaaagtgcggtctaatgctgccatcggcgccgtctttgtggacgaaaaccagtggaatagcgcgaaggaggctgttgaggatgaacgcttctgggacctggtgcatagagagcgggaacttcacaaacaggggaagtgcgccacatgcgtctacaacatgatgggaaaacgcgagaagaagctgggcgaatttgggaaagccaagggctccagagctatttggtacatgtggctcggagcccggttcctggagttcgaggctctgggctttatgaatgaagatcactggttctctcgcgagaacagcctctccggggtggaaggagagggcctgcataaacttgggtatatcctgagagacatttctaagatccctggaggcaatatgtacgccgatgacaccgcggggtgggatacacggatcaccgaggacgatctccagaacgaagcccgcattacagacatcatggagcccgaacacgctctgcttgccaaaagcatttttaagctgacctatcaaaataaagtcgtgagagttcagcggcctgctaagaacggcacggtgatggatgtcatctcccgcagagaccagcggggatctggccaggtggggacctacggactcaatacattcaccaacatggaggcccaactgattagacagatggaaagcgagggcatcttttcccccagcgagctggaaacaccgatcctcgcggagcgcgtgctggattggcttgaaaagtatggggttgagcggctgaaaagaatggccatttctggagacgactgtgtggtcaagcctatcgatgaccgcttcgctaccgccctcacggctctgaacgatatgggcaaagtgcggaaggacattccccagtgggaaccttccaaagggtggaatgattggcagcaagttcccttttgcagccatcacttccaccagcttatcatgaaggacggcagagagattgtggtcccttgtcgcaaccaggatgagctggtgggacgggccagagtctctcagggcgctgggtggtccctccgcgaaacagcctgcctgggaaagagctacgcgcaaatgtggcagctgatgtattttcatcggagagacctccgcctggccgctaatgccatctgttccgccgtgcccgttgattggattccgacctctcggacaacctggagcatccacgctcatcaccagtggatgacgaccgaggacatgctttccgtgtggaacagagtctggatcgaagagaatccttggatggaagataaaacacatattagctcttggggcgacgtgccctacctggggaagcgggaggaccaatggtgcggatccctcatcggcctgaccgccagagcgacatgggctaccaacattcaggttgccatcaatcaggtgcgccggcttattgggaacgagaattacctggattatatgacaagcatgaaaagattcaagaacgaatctgaccccgagggcgccctctggtga

SEQ ID NO: 18564 - RNA, 9879 nt, synthetic construct
  misc_feature 1..9879: note = derived and/or modified CDS sequence (opt5) from DENV-1__FJ639686__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagagcaggacgctaacttcgtgtgccggcgcacatttgtggatagaggctggggcaatgggtgtggactcttcggcaaagggtctctgatcacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatccggtacgagggcacagacgcgccgtgcaagatccctttctccacccaagatgaaagaggggttacacagaacggacgcctgattacggctaatcccatcgtgaccgacaaagagaagcctgtcaacattgaagccgagcccccctttggcgagagctatatcgtgattggggccggagaaaaagctcttaagctctcttggttcaaaaagggcagctccatcgggaagatgtttgaggccacagctcggggcgccagacgcatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctcggtccacaagcttctctatgacctgtattgccgtgggcctggttacactgtaccttggggtgatggtccaggctgattccggatgcgtgatcaactggaaaggcagagaactcaagtgtgggagcggaatttttgttaccaatgaggtgcacacatggaccgaacaatataaattccaggccgactcccctaagcgcctgtctgcggccatcggcaaggcttgggaggagggggtctgcggcatccggagcgccacgagactggaaaacattatgtggaaacagatctccaacgagctcaatcatattctgcttgaaaacgacatgaagtttacagtggttgtgggagatgtcgctggcatcctggcccaggggaaaaagatgattcgcccgcaacccatggagtacaaatattcttggcggagctggggaaaggccaaaatcatcggcgctgacgtgcagaataccaccttcattatcgatgggcctaacacacccgaatgtcctgacgatcagagagcgtggaatatttgggaggtggaggactacggatttggcatcttcaccacgaacatttggctcaagctgcgcgattcctatacacaggtctgcgaccaccggctgatgagcgccgctatcaaggattctaaagccgttcacgccgacatgggctactggatcgaatccgagaagaatgaaacctggaaacttgctagagccagcttcattgaggtgaagacatgtatctggcccaaatctcataccctctggtccaacggggtgctggaaagcgagatgattatcccgaagatttatggaggccctatctctcaacacaattaccggcccgggtactttacacagaccgcgggaccttggcatctgggcaagctcgagctggatttcgacctttgcgaagggacgaccgtcgtggttgatgagcactgcggaaaccgcggccccagcctgagaacaaccacagtgaccggcaaaatcattcacgaatggtgttgccggtcctgtacgctccctcccctgagatttcgcggggaggacggatgctggtatggcatggagatccggccggtcaaggaaaaagaggaaaatctggtgaagagcatggtttctgctgggtccggagaggtggacagcttctcccttggcctcctgtgtatttctatcatgattgaagaggtcatgagaagccgctggtccagaaaaatgctgatgacagggaccctcgccgtgtttctgcttctgatcatgggacagctcacatggaacgatctgattcggctgtgcatcatggttggcgccaatgcttctgaccgcatgggcatggggaccacctaccttgccctgatggcgacattcaagatgagacctatgtttgctgtgggactcctgttccggcgcctcacgagcagagaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataaaatctggggccggcgctcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagagagacgataccctgacaattcttctgaaagccaccctcctggctgtttctggagtgtatcctctcagcatccccgccacactgttcgtctggtacttctggcaaaagaaaaagcagcggtccggcgtgctttgggacaccccttctcccccggaagtcgagcgcgccgtgctggatgacggcatttatagaatcatgcagcgggggctgctcggaagaagccaggttggcgtgggggtctttcaagaaaacgtgttccatacgatgtggcacgttacccgcggagctgtgctgatgtaccagggcaaacggcttgagccttcctgggccagcgtcaagaaggacctgatttcttacgggggaggctggagactccagggctcctggaatacaggggaggaagtgcaggtgatcgcggttgagcccggaaaaaaccctaagaatgtccaaaccgctcccggcacatttaaaaccccggaaggggaggtgggagccattgccctggatttcaagcctggcacaagcgggtctcccatcgtgaaccgcgaaggaaaaatcgtcggcctctatggcaatggggtggttacgacctccggaacatacgtgagcgctattgcccaggcgaaggcttcccaggagggccctctgcccgagatcgaagacgaggtctttcggaagagaaaccttaccattatggatctgcaccccgggtctggaaaaacccgccggtatctgcctgccatcgtgagagaagccattaagcgcaaactccggacactgatccttgctccgacgagagttgtggccagcgagatggctgaagccctgaagggcatgcccatccggtaccaaaccacagcggtcaaatccgagcataccgggaaggagattgtggacctcatgtgccacgccacattcaccatgcgcctgctgagccctgttagagtgcccaattataacatgatcattatggatgaagctcattttacggacccttcttccatcgccgctcggggctacattagcacacgcgtcggaatgggcgaggccgccgctatcttcatgaccgcgaccccccctgggtctgtggaagcctttccgcagagcaatgctgtgatccaggatgaggaaagagacattcccgagcggtcctggaactctggatatgagtggatcacagatttccctggcaagaccgtctggtttgttcccagcattaaatccgggaatgacatcgccaactgtctcagaaagaatggaaaacgcgtgattcagctttctcggaagacattcgataccgaataccaaaaaacgaagaacaacgactgggactacgtggtcacaaccgatatcagcgagatgggcgccaatttcagagctgaccgcgtgattgatcctcggagatgcctgaagcccgttatcctgaaagacgggccggaacgcgtgatcctcgccggccctatgcccgtcacagtggcgtccgctgcccagcggagaggacgcattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgggaaaagagcgcggccatcgatggggagtatcgcctgagaggagaggctcggaaaaccttcgttgaactgatgcgcagaggcgacctcccggtgtggctttcttacaaggtcgcctccgaggggtttcaatatagcgatcggagatggtgcttcgacggcgaacgcaacaatcaggtgctggaggaaaacatggatgtcgagatctggacaaaggagggagaacggaaaaagctgagaccccgctggctcgacgctcggacctactccgaccctctggcccttagagagtttaaagaattcgctgccggccggcgctctgtgagcggggatctgattctcgagatcggaaagctgccccagcacctgacacagagagcgcaaaatgccctcgacaaccttgttatgctgcataattccgaacagggcgggcgggcttatcgccacgccatggaggagctgcctgataccattgaaacactcatgctgcttgctctgatcgccgtgctcaccggaggcgtgacgctgtttttcctgtctggcagagggctcggaaaaacaagcattggccttctgtgtgtcatggcctccagcgttctgctctggatggcttctgtggagccccattggatcgcggcctccatcattctggaatttttccttatggtgctgctcatcccggagcctgaccggcagcgcaccccccaggataaccaactggcttacgtcgtgattgggctgctctttatgatccttaccgttgccgccaatgagatgggactgctggaaacaaccaagaaagacctcggcattgggcacgtggctgtcggaaaccaccatcacgccgcgatgctggatgtggaccttcatcctgccagcgcttggacactgtacgccgtcgctacgaccatcattacacccatgatgagacacaccatcgagaacacaaccgccaatatctctctcacggcgattgccaaccaggctgccatcctgatgggcctggataagggctggcctatttccaagatggacatcggggtgcccctccttgctctgggatgctatagccaggttaatccgctgaccctcacagccgctgtgctgatgcttgtcgcccattacgcgattatcggccctgggctgcaagccaaagctacccgggaagcccagaagcgcacagctgccggaatcatgaaaaaccccaccgtggatggcattgttgccatcgacctcgatcccgtggtctatgacgcgaagttcgagaaacagctggggcagattatgctgctcatcctttgtacgtctcaaattctgctgatgagaacaacctgggctctctgcgaaagcatcacactggccaccggacctcttaccacactgtgggagggctccccgggcaagttttggaatacgaccatcgctgtgtctatggccaacattttccgggggagctacctcgccggagctggcctggccttctccctgatgaagagcctcgggggaggcagacgcgggacaggagcgcagggcgagacccttggcgaaaaatggaagcggcagctgaatcagctgtccaaatctgagtttaacacatataagagaagcgggatcatggaagtggaccgctccgaggccaaagaaggactcaagcggggcgagattaccaagcacgctgtttctagagggacggccaaactgcgctggttcgtcgagcggaatcttgtgaagcccgaaggaaaagtgatcgatctgggctgtgggagaggaggctggagctactattgcgctggcctcaagaaagtcacagaggttaaggggtacaccaagggaggccctgggcacgaagagcccattcctatggccacctacggatggaacctggtgaaactgcattccggcaaggacgtgtttttcgtcccccctgaaaaatgtgatacactcctttgcgacatcggggagtctagcccgaatcccaccattgaggaaggacgcacactgcgggtgctgaagatggttgagccttggctcagaggcaaccaattttgtatcaaaatcctgaatccctatatgccttccgtggtcgaaacgcttgagcagatgcagcgcaagcacggcgggatgctggtgcggaaccccctcagcagaaattctacccatgagatgtactgggtttcctgcggaacaggcaacattgtgagcgcggtcaatatgacctctcgcatgctgctgaacagattcacaatggcccaccggaaaccgacctatgaacgcgatgtggacctcggggctggaacgagacacgtggccgtcgagcctgaagttgctaacctggatatcattggccagcggatcgagaatattaagcatgaacacaagtccacctggcattacgacgaggataacccctataaaacatgggcctaccacgggagctatgaggtgaagccctctggatccgctagctccatggtgaatggcgtcgtgaaacttctgaccaagccttgggacgttatccccatggtgacacaaatcgccatgaccgatacaaccccttttggccagcagagagtcttcaaagaaaaggtggacacgcggacaccgaaggcgaaacgcgggaccgcccaaattatggaggttaccgctaagtggctctggggatttctgagcagaaacaaaaagccccggatctgtacacgcgaagagttcacgagaaaagtgcggtctaatgccgctattggcgccgtctttgtggacgaaaaccagtggaatagcgccaaggaggcggttgaggatgaacgcttctgggaccttgtgcatagagagcgggaactgcacaagcaggggaaatgcgctacctgcgtctacaacatgatgggaaagcgcgagaaaaagctcggcgaatttgggaaagccaagggctccagagccatctggtacatgtggctgggagctcggttcctggagttcgaggccctcggctttatgaatgaagatcactggttctctcgcgagaacagcctgtccggggtggaaggagagggccttcataagctggggtatattctcagagacatctctaaaatccctggaggcaatatgtacgctgatgacacagccgggtgggatacccggattacagaggacgatctgcagaacgaagcgcgcatcaccgacattatggagcccgaacacgcccttctggctaagagcatctttaaactcacatatcaaaataaggtcgtgagagttcagcggcctgccaaaaacggcaccgtgatggatgtcatttccagacgcgaccagcggggatctggccaggtggggacgtacggactgaataccttcacaaacatggaggctcaactgatcagacagatggaaagcgagggcatcttttcccccagcgagctcgaaaccccgaacctggccgagcgcgtgcttgattggctggaaaagtatggggttgagcggctcaaaagaatggcgatttctggagacgactgtgtggtcaagcctatcgatgaccgcttcgccacagctctgaccgcccttaatgatatgggcaaggtgcggaaagacattccccagtgggaaccttccaaggggtggaacgattggcagcaagttcccttttgcagccatcacttccaccagctgatcatgaaagacggcagagagattgtggtcccttgtcgcaatcaggatgagctcgtgggacgggctagagtctctcagggcgccgggtggtccctgcgcgaaacggcttgcctgggaaagagctacgcccaaatgtggcagctcatgtattttcatcggagagacctgcggcttgcggccaacgctatctgttccgccgtgcccgttgattggattccgacatctagaaccacatggagcatccacgcccatcaccagtggatgaccacggaggacatgctgtccgtgtggaatcgcgtctggatcgaagagaacccttggatggaagataaaacccatattagctcttggggcgacgtgccctacctcgggaagcgggaggaccaatggtgcggatccctgatcggccttacagctagagccacctgggcgacaaatattcaggttgctatcaaccaggtgcgcagactgattgggaatgagaactacctcgattatatgaccagcatgaagcggttcaaaaatgaatctgaccccgagggcgccctgtggtga

SEQ ID NO: 18565 - RNA, 9879 nt, synthetic construct
  misc_feature 1..9879: note = derived and/or modified CDS sequence (opt5) from DENV-1__FJ639687__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgccgaggctttccctcagagcaatgccgtgatccaggatgaagaacgggacatcccggagcgctcctggaactctggatatgagtggattacagattttcccggcaaaaccgtctggttcgttcctagcatcaagtccgggaatgacattgccaactgtctgagaaagaatggaaaacgggtgatccagctcagccgcaagaccttcgatacagaataccagaagaccaagaacaacgactgggactacgtggtcacaaccgatatttctgagatgggcgctaattttagagccgaccgggtgatcgatcccagacgctgccttaaacctgttattctgaaggacgggcccgaacgggtgatcctggcgggcccgatgcctgtcacggtggcttccgccgcccagagacgcggacggatcggcagaaaccacaataaggagggggatcagtatatttacatgggacagcccctcaacaatgacgaggatcatgctcactggacagaagccaaaatgctgcttgacaacatcaatacccccgagggcattatccctgcgctgttcgaacccgagcgcgaaaagagcgccgctattgatggggagtatcggctcagaggagaggcccgcaaaacatttgttgaactgatgagacggggcgacctgcctgtgtggctctcctacaaggtcgcttctgaggggttccaatatagcgatcgcagatggtgctttgacggcgaacggaacaatcaggtgcttgaggaaaacatggatgtcgagatctggaccaaagagggagaacgcaagaaactgagaccgcggtggctggacgccagaacgtactccgaccccctcgctctgcgcgagttcaaggaatttgccgcgggccggagatctgtgagcggggatcttatcctggagattggaaagctccctcagcacctgacccagcgcgcccaaaatgctctggacaacctcgttatgcttcataattccgaacagggcgggcgggcctatagacacgctatggaggagctgcccgatacaatcgaaaccctgatgctcctggcccttattgccgtgctgacaggaggcgtgaccctcttctttctgagcggccgggggctgggaaaaacatctatcggcctcctttgtgtcatggcttccagcgttctgctgtggatggcgtctgtggagcctcattggattgccgcttccatcatcctcgagttctttctgatggtgcttctgattcccgagccggaccgccagagaacccctcaggataaccaactcgcctacgtcgtgatcgggctgctgttcatgattctcacggttgccgctaatgagatgggacttctggaaacaaccaagaaagacctgggcatcgggcacgtggccgtcgagaaccaccatcacgcggccatgctcgatgtggacctgcatcccgctagcgcctggaccctttacgctgtcgccacaaccattatcacacctatgatgcggcacacgattgaaaacaccacagcgaatatctctctgaccgccatcgctaaccaggccgctattctcatgggactggataagggctggcccatcagcaaaatggacattggcgtgcctctgctcgcccttgggtgctattcccaggttaatcccctgacactgaccgctgccgtgctcatgctggtcgcgcattacgccatcattggaccgggccttcaagctaaggccacgcgcgaggctcagaagagaaccgccgccgggatcatgaaaaaccctacagtggatggaatcgttgcgattgacctggatcccgtggtctatgacgctaagtttgaaaaacagctcggccagatcatgctgctgattctctgtacctctcaaatccttctgatgcggacaacctgggccctgtgcgagagcattacgctcgctacagggcccctgaccacactttgggagggatcccctggcaagttctggaataccaccatcgccgtgagcatggccaacatcttccgcggctcctacctggctggggccggactcgcgttttctctgatgaaaagcctgggcgggggaagacggggcacaggggcccagggagaaacgctcggcgagaagtggaagcgccagcttaatcagctgtccaaatctgagttcaacacctataagagaagcggcattatggaggtggaccggtccgaagctaaagaggggctgaagagaggagagacaaccaaacacgccgtttctcgcggcacagctaagctccggtggtttgtcgaaagaaatctggtgaagccggaggggaaagtgatcgatcttggatgtggccgcgggggatggagctactattgcgccggcctgaagaaagtcaccgaagttaagggctacacgaaagggggacccggccacgaggaacctattcccatggcgacatacgggtggaacctcgtgaagctgcattccggaaaagacgtgttctttgtccctcccgagaagtgtgataccctgctctgcgacatcggcgagagctctcctaatccgaccattgaagaggggcggacacttagagtgctgaagatggttgaaccctggctgcgcggaaaccaattctgtatcaaaattctcaatccttatatgccctccgtggtcgagaccctggagcagatgcagcggaagcacggcggcatgcttgtgagaaaccctctgagccgcaattctacacatgaaatgtactgggtttcctgcgggacgggaaacatcgtgagcgccgtcaatatgacctctcggatgctcctgaacagatttacaatggctcaccgcaaacccacctatgagcgggatgtggacctgggcgccgggacaagacacgtggctgtcgaaccggaggttgccaacctcgatatcattggacagcgcatcgaaaatattaagcatgagcacaaatccacctggcattacgacgaggataacccttataagacgtgggcttaccacggcagctatgaagtgaagccctccgggagcgcctctagcatggtgaatggagtcgtgaaactgcttaccaagccctgggacgttatccctatggtgacacaaattgcgatgaccgatacaacccccttcggccagcagagagtctttaaagagaaggtggacacacggacccctaaagccaagcgcggcacggctcaaatcatggaagttacagccaagtggctgtgggggttcctctccagaaacaaaaagccgcggatctgtaccagagaggaatttacccggaaagtgcgctctaatgctgccattggagccgtcttcgtggacgagaaccagtggaatagcgcgaaggaggctgttgaagatgagagattttgggacctggtgcatcgggaacgcgagcttcacaaacagggcaagtgcgccacatgcgtctacaacatgatggggaagagagagaagaagctgggagagttcggcaaagccaaggggtcccgggctatctggtacatgtggctcggcgcccgcttcctggagtttgaagctctgggattcatgaatgaggatcactggttttctagagaaaacagcctctccggcgtggagggggagggactgcataaacttggctatattctgcgggacatctctaagattagcgggggaaatatgtacgccgatgacacggcgggctgggatacccgcatcacagaagacgatctccagaacgaggccaaaatcaccgacattatggaacccgagcacgctctgcttgccaagtccatcttcaagctgacatatcaaaataaagtcgtgagagttcagcggcctgctaagaacgggaccgtgatggatgtcattagccgcagagaccagcggggctctggacaggtgggcacatacgggctcaatacctttacgaacatggaagcccaactgatccgccagatggagtccgagggaattttcagcccctctgaactggagacccctaacctcgcggaaagagccctggattggcttgagaaacatggcgtggaacggctgaagagaatggctatctccggggacgactgtgttgtgaaacccatcgatgaccgctttgccacagctctcaccgccctgaatgatatgggaaaggtccggaaggacattccgcagtgggagcctagcaaaggctggaacgattggcagcaagtgcccttctgctcccaccactttcatcagcttatcatgaaggacgggagagagattgttgtgccttgtcgcaatcaggatgaactggtcggccgggctagagtgtctcagggagccggctggagcctcaaagagacagcgtgcctggggaagtcctatgcccaaatgtggcagctgatgtacttccaccgccgggacctcagactggctgccaacgccatctgtagcgctgtccccgtggattgggttcctacctctcgcacgacatggtccattcatgcccaccatcagtggatgaccacagaagacatgcttagcgtgtggaatcgggtctggatcgaggaaaacccctggatggaggataaaacccacatttctagctgggaggacgtgccgtatctgggaaagagagaagaccaatggtgcggctccctcatcgggctgacggcgcgcgctacctgggccacaaatatccaggttgccattaaccaggtgcggagacttatcggaaatgagaactacctggattacatgacctctatgaagcggtttaaaaatgaaagcgaccctgagggcgctctctggtga

SEQ ID NO: 18566 - RNA, 9879 nt, synthetic construct
  misc_feature 1..9879: note = derived and/or modified CDS sequence (opt5) from DENV-1__FJ639688__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaatatgtgcacccttattgccatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatgtctgggaggttgaggactacggattcggcatctttaccacgaacatttggctgaagctgcgcgattcctatacacaggtgtgcgaccaccggcttatgagcgccgctatcaaagattctaaggccgtgcacgccgacatgggctactggattgaatccgagaaaaatgaaacctggaagctcgctagagccagcttcatcgaggtcaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgttgtggtcgatgagcactgcggaaaccggggccccagcctcagaacaaccacagtgaccggcaagattatccacgaatggtgttgccggtcctgtacgctgcctcccctgcgcttcagaggggaggacggatgctggtatggcatggagatccggccggttaaagaaaaggaggaaaatcttgtcaagagcatggtctctgctgggtccggagaggtggacagcttttccctcggcctgctgtgtatttctatcatgattgaagaggttatgagaagccgctggtcccggaaaatgctcatgacagggaccctggccgtgttctttcttctgatcatgggacagctcacatggaacgatctgattagactgtgcatcatggtcggcgccaatgcttctgaccgcatgggcatggggaccacctaccttgccctgatggcgacattcaagatgagacctatgtttgctgtgggactcctgttccggcgcctcacgagcagagaggtgctgcttctgaccattggcctctccctggtcgcctctgttgaactgcccacaagccttgaggaactgggggatggactcgccatgggcatcatgatcctgaaactcctgaccgactttcaatcccatcagctttgggctacactgctcagcctgaccttcattaagacgacattttctctgcactatgcctggaaaaccatggctatggtgctttccatcgtgagcctgctccccctgtgtctctctaccacatcccagaagaccacatggctgcctgtccttctggggagcctgggatgcaagccgctcacgatgttcctgattgccgagaacaaaatctggggccggcgctcttggccccttaatgaaggcattatggcggtggggatcgtttccatcctgctcagctccctgctcaagaacgatgtgcctctggccggaccccttattgctggcgggatgctgatcgcctgttacgtcattagcggatctagcgctgacctgtccctcgagaaagccgccgaggtgtcttgggaagaggaagctgagcatagcggcgcgtcccacaacatcctggttgaagtgcaggatgacgggaccatgaagattaaagatgaggagagagacgatacacttaccatcctgctcaaggccacactgctcgctgtctctggagtgtatcctctgagcatccccgccaccctttttgtctggtacttctggcagaagaagaagcagcggtccggcgtgctgtgggacacgccttctcccccggaagttgagcgcgccgtgctggatgacggcatttatagaatcatgcagcgggggctcctgggacgcagccaggtcggcgtgggggttttccaagaaaatgtgtttcataccatgtggcacgtcacaagaggagctgtgcttatgtaccagggcaaacggctggagccttcctgggccagcgtgaagaaagacctcatttcttacgggggaggctggagactgcagggctcctggaacaccggggaggaagttcaggtcatcgcggtggagcccggaaagaatcctaaaaacgtgcaaacagctcccggcaccttcaagacaccggaaggggaggtcggagccattgccctcgattttaagcctggcacgagcgggtctcccatcgtgaatcgcgaaggaaaaattgttggcctgtatggcaacggggtggtcaccacatccggaacctacgtgagcgctatcgcccaggcgaaggcttcccaggagggccctcttcccgagatcgaagacgaggttttccggaaaagaaatctgaccattatggatctgcaccccgggtctggaaagacacgccggtatctccctgccatcgtgagagaagccattaaacgcaagctgcggacgcttatcctggctccgaccagagtcgtggccagcgagatggctgaagccctcaagggcatgcccattcgctaccaaacaaccgcggttaaatccgagcatacagggaaggagatcgtggacctgatgtgccacgccacctttacgatgcggctgctcagccctgtcagagtgcccaactataatatgatcattatggatgaagctcatttcacagacccttcttccatcgccgctcggggctacattagcacccgcgtgggaatgggcgaggccgccgctatctttatgaccgcgacaccccctgggtctgtcgaagccttcccgcagagcaacgctgttattcaggatgaggaaagagacatccccgagcggtcctggaactctggatatgagtggatcaccgattttcctggcaaaacagtgtggttcgtgcccagcattaagtccgggaacgacatcgccaattgtcttcgcaaaaacggaaagagagtcattcagctgtctcggaagacctttgatacggaataccagaaaacaaagaataacgactgggactacgtggttaccacagatatcagcgagatgggcgccaacttcagagctgaccgcgtgattgatcctcggagatgcctgaaacccgtcatcctcaaggacgggccggaacgcgtgattctggccggccctatgcccgttaccgtggcgtccgctgcccagcggagaggacgcatcggccggaatcacaacaaagagggggatcagtatatctacatgggacagccccttaataacgacgaggatcatgcccactggacggaagctaagatgctgctcgacaatattaacacccctgagggcatcattcccgccctgttcgaacctgagagagaaaagagcgcggccatcgatggggagtatcgcctgagaggagaggctcggaaaacatttgtcgaactcatgcgcagaggcgaccttccggtgtggctgtcttacaaggtcgcctccgaggggttccaatatagcgatcggcgctggtgctttgacggcgaaagaaataaccaggtgctggaggaaaatatggatgttgagatttggaccaaagagggagaacggaagaaactcagaccccgctggctggacgctcggacatactccgaccctcttgccctgagagagttcaaggaatttgctgccggccgccggtctgtgagcggggatctcatcctggagatcggaaaactgccccagcacctcacccagagagcgcaaaacgcccttgacaatctggtgatgctgcataactccgaacagggcgggcgggcttatcgccacgccatggaggagctccctgatacaattgaaaccctgatgcttctggctctcatcgccgtcctgacgggaggcgttacactgttctttctctctggcagagggcttggaaagaccagcattggcctgctgtgtgtgatggcctccagcgtgctcctgtggatggcttctgtcgagccccattggatcgcggcctccattatccttgagttctttctgatggtgctcctgatcccggagcctgaccggcagcgcacaccccaagataatcaactggcttacgttgtgattgggctccttttcatgatcctgaccgtcgccgccaacgagatgggactgctcgaaaccacaaagaaagacctgggcattgggcacgtggctgccgagaatcaccatcacgcggccatgcttgatgtcgacctgcatcctgctagcgcctggacgctctacgctgtggccaccacaatcattacccccatgatgagacacacaatcgaaaacaccacggcgaacatttctctgaccgccatcgctaatcaggccgctatcctgatgggactcgataagggctggcctatttccaaaatggacatcggcgttccccttctggccctggggtgctatagccaggtgaacccgctcacactgaccgctgccgtccttatgctggtggcgcattacgccattatcggacctggcctccaagctaaggccacacgggaggctcagaaacgcaccgccgccgggattatgaagaatcccacggttgatggaatcgtggcgatcgacctggatcccgtcgtgtatgacgctaagtttgaaaaacagctgggccagattatgctccttatcctgtgtacatctcaaattctgctcatgagaaccacatgggccctgtgcgagagcatcacccttgctaccgggcctctgacaacgctctgggagggatccccgggcaagttctggaacaccacaattgccgtgtctatggccaatatctttcggggcagctacctggctggggccggactggcgttctccctcatgaaaagccttggcgggggacgcagaggcaccggggcccagggagaaacactgggcgagaagtggaaacggcagctgaaccagctctccaagtctgagttcaatacctataagagaagcggcatcatggaggttgaccgctccgaagctaaagaggggctgaagcggggagagacgacaaaacacgccgtctctagaggcaccgctaaacttcgctggtttgtggaacggaacctggtgaaacccgaggggaaggtcattgatctcggatgtggcagagggggatggagctactattgcgccggcctgaagaaagttaccgaagtgaagggctacacaaaagggggacctggccacgaggaacccatccctatggcgacctacgggtggaatctggtgaagctccattccggaaaagacgtcttctttattccccctgagaagtgtgatacacttctgtgcgacatcggcgagtctagcccgaaccccacgattgaagaggggcgcaccctgcgggtgctcaaaatggttgaaccttggctgagaggaaatcaattctgtatcaagattcttaacccctatatgccttccgtggtcgagacactggagcagatgcagcgcaagcacggcggcatgctcgtgcggaatcccctgagcagaaactctacccatgaaatgtactgggtttcctgcgggacaggaaatatcgtgagcgccgtcaacatgacctctcgcatgctgctcaatcggtttacgatggctcacagaaaaccgacctatgagcgcgatgtggacctgggcgccgggacaagacacgtggctgtcgaacctgaggttgccaaccttgatatcattggacagcggatcgaaaacattaagcatgagcacaaatccacctggcattacgacgaggataatccctataagacatgggcttaccacggcagctatgaagtgaaaccctctgggtccgccagctccatggtgaacggagtcgtgaagctgctcaccaagccttgggacgttatccccatggtgacacaaatggcgatgaccgatacgacacctttcggccagcagcgcgtctttaaagagaaggtggacaccagaaccccgaaagccaagcggggcacagctcaaattatggaagttacggccaaatggctgtgggggttccttagcagaaataagaagccccggatctgtacccgcgaggaatttacaagaaaagtgcggtctaacgctgccatcggagccgtcttcgtggacgagaatcagtggaacagcgcgaaggaggctgttgaagatgagcgcttttgggacctggtgcatagagaacgggagctccacaaacagggcaagtgcgcgacctgcgtctacaatatgatggggaaacgcgaaaagaagctgggagagttcggcaaagccaaggggtccagagctatttggtacatgtggctgggcgcccggtttctcgagttcgaagctctgggattcatgaacgaggatcactggttttctcgcgaaaatagcctttccggcgtggagggggagggactgcataaactcggctatatcctgagagacatttctaagatccctgggggaaacatgtacgccgatgacacagcgggctgggatacccggattacagaagacgatcttcagaatgaggcccgcatcaccgacatcatggaacccgagcacgctctgctcgccaaaagcattttcaagctgacgtatcaaaacaaagtcgtgagagttcagcggcctgctaagaatgggaccgtgatggatgtcatctcccgcagagaccagcggggctctggacaggtgggcacatacgggctgaacacctttacaaatatggaagcccaactcattagacagatggagagcgagggaatcttctcccccagcgaactggagaccccgaaccttgcggaacgcgtgctggattggctcgagaagtatggcgttgaacggctgaaaagaatggccatttctggggacgactgtgtggtcaagcctatcgatgaccgctttgctacggcccttacagctctgaacgatatgggaaaagtgcggaaggacatcccccagtgggagccttccaaaggctggaatgattggcagcaagttcccttctgcagccatcactttcaccagctcattatgaaggacgggagagagatcgtggtcccttgtcgcaaccaggatgaactggtgggccgggccagagtctctcagggagctggctggtccctgcgcgagaccgcctgcctcggaaagagctacgcgcaaatgtggcagctgatgtatttccatcggagagaccttcgcctggccgctaatgccatttgttccgccgtgcccgttgattggatcccgacatctcggaccacgtggagcattcacgctcatcaccagtggatgaccacagaagacatgctctccgtgtggaacagagtctggatcgaggaaaatccttggatggaggataaaacccatattagctcttggggagacgtgccctacctgggcaagcgggaggaccaatggtgcgggtcccttatcggactgacagccagagcgacctgggctacaaacatccaggttgccatttaccaggtgcgccggctcatcggcaatgaaaactatctggattacatgaccagcatgaaaagatttaagaatgagtctgaccccgaaggggccctgtggtga

SEQ ID NO: 18567 - RNA, 9879 nt, synthetic construct
  misc_feature 1..9879: note = derived and/or modified CDS sequence (opt5) from DENV-1__FJ639689__SS-prME
  source 1..9879: mol_type = other RNA
agcgtgaccatgctgctcatgctgatgcccacagcccttgctttccacctgacgatcagaggcggggagcctcatatgattgtctccaagcaggaacggggaaaatctctcctgtttaagaccagcgccggcgttaacatgtgcacacttatcgcgatggacctgggggagctctgtgaagataccatgacatacaaatgcccgcgcattaccgaggctgaacccgacgatgtggactgttggtgcaatgccacagatacctgggtgacgtatggaacctgttcccaaacaggcgagcacagacgggacaagcgctctgtcgccctggctcctcatgtggggctgggactcgagaccagaacagaaacctggatgagctccgagggcgcctggaaacagatccagcgggttgaaacgtgggctctgcgccaccccggcttcacagtgattgccctttttctggcgcatgccatcgggacctctatcacacagaagggaattatcttcattctcctgatgcttgtcacccctagcatggctatgagatgcgtgggcatcgggtcccgggattttgttgagggactgagcggcgccacctgggtggacgtcgtgctcgagcacgggtcttgtgtgacaacgatggctaaggataaacccaccctggacattgaactgctcaagacagaggtcaccaaccctgccatcctgcgcaaactttgcattgaagcgaagatctccaatacaaccacggatagcagatgtccgacacaaggagaggccaccctggttgaagagcaggacgctaacttcgtgtgccggcgcacctttgtggatagaggctggggcaatgggtgtggactcttcggcaaagggtctctgatcacatgcgccaagtttaagtgcgtcaccaaacttgagggaaagattgtgcagtacgaaaacctgaaatattccgttatcgtgacagtccacacgggcgaccagcatcaagtggggaatgagagcaccgaacacggaacaaccgctacaattaccccccaggcccctacgaccgagatccagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaattcagacctccggaacaaccacaatctttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaattcctttctccacacaagatgaaaagggggttacccagaacggacggctgatcacagctaatcccattgtgacggacaaagagaagcctgtcaacatcgaagccgagcccccctttggcgagagctatattgtgatcggggccggagaaaaagctcttaagctctcttggttcaagaaaggcagctccatcgggaagatgtttgaggccaccgctagaggcgcccgccggatggcgattctgggagatacagcctgggacttcggctctatcgggggagtgtttaccagcgttggcaaactggtccatcagattttcgggacagcttacggagtgctcttttccggcgtgagctggaccatgaagatcgggattggcgtcctgcttacgtggctgggactcaattctagatccaccagcttctctatgacatgtatcgccgtgggcctggttaccctgtaccttggggtgatggtccaggctgattccggatgcgtgattaactggaaaggccgcgaactcaagtgtgggagcggaatctttgttacaaatgaggtgcacacctggacagaacaatataagttccaggccgactcccctaaacggctgtctgcggccatcggcaaggcttgggaggagggggtctgcggcattagaagcgccacccgcctggaaaacatcatgtggaaacagatttccaacgagctcaatcatatcctgcttgaaaacgacatgaagtttacggtggttgtgggagatgtcgctggcattctggcccaggggaaaaagatgatccggccgcaacccatggagtacaaatattcttggagaagctggggaaaggccaagatcattggcgctgacgtgcagaatacaaccttcatcattgatgggcctaacacccccgaatgtcctgacgatcagcgcgcgtggaatatctgggaggtggaggactacggatttggcattttcacaaccaacatctggctcaaactgcgggattcctatacgcaggtctgcgaccacagactgatgagcgccgctatcaaggattctaaagccgttcacgccgacatgggctactggattgaatccgagaagaatgaaacatggaaacttgctcgcgccagcttcatcgaggtgaagacctgtgtgtggcccaagtctcatacactctggtccaacggggtcctggaaagcgagatgattatcccgaaaatttatggaggccctatctctcaacacaattaccggcccgggtactttacccagacagcgggaccttggcatctgggcaagctcgagctggatttcgacctttgcgaagggaccacggtggttgtggatgagcactgcggaaacagaggccccagcctgcggaccacaaccgtcacaggcaaaatcattcacgaatggtgttgccgctcctgtaccctccctcccctgagatttcggggggaggacggatgctggtatggcatggagatcagaccggtgaaggaaaaagaggaaaatctggttaagagcatggtgtctgctgggtccggagaggtcgacagcttctcccttggcctcctgtgtatttctatcatgacggaagaggtgatgcgcagccggtggtccagaaagatgctgatgacagggaccctcgccgtttttctgcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccgtgggcctctccctggtcgcctctgttgaactgcccaacagccttgaggaactgggggatggactcgccatgggcatcatgatcctgaagctcctgacagactttcaaccccatcagctttgggctaccctgctctccctgacattcattaaaaccacgtttagcctgcactatgcctggaagacaatggctatggtgctttctatcgtgtccctgttccctctctgtctgagcaccacctctcagaaaacaacctggctcccggtcctgcttgggtccctgggatgcaagcccctgacaatgtttctcattgccgagaataagatctggggccgcagaagctggcctctgaacgaaggcattatggcggtggggatcgtttctatccttctgtccagcctcctgaaaaacgatgtgcccctcgccggacctctgattgctggcgtcatgcttatcgcctgttacgtgatttccgggagctctgctgacctgagcctggagaaggccgccgaggtttcctgggaagaggaagctgagcattctggagcgagccacaatatcctcgtggaagtccaggatgacggcacgatgaaaattaaggatgaggagcgggacgataccctgacaatccttctgaaagccaccctcctggctgtgtccggggtctatcccctctctatccctgccacactgttcgtgtggtacttctggcaaaagaaaaagcagcgcagcggagttctttgggacaccccctccccgcctgaagtggagagagccgtcctggatgacggcatttatcggatcatgcagcgcggcctgctcgggagatctcaggtgggagttggcgtgtttcaagaaaacgtcttccatacgatgtggcacgtgacccggggggctgtgctgatgtaccagggaaagagacttgagcccagctgggcctccgttaaaaaggacctgattagctacggcgggggatggcgcctccagggctcttggaatacaggcgaggaagtccaggtgatcgcggtggagcctgggaaaaaccccaagaatgtccaaaccgctccgggaacatttaaaacccctgaaggcgaggtgggggccattgccctggatttcaagcccggaacatccggcagccctatcgttaaccgggaagggaagattgtgggactctatggcaatggcgtcgtgacgacctctgggacatacgtttccgctatcgcccaggcgaaagctagccaggagggacccctgcccgagatcgaagacgaggtgtttagaaagcgcaaccttaccattatggatctgcaccctggctccgggaaaacccggagatatctgccggccatcgtccgcgaagccattaagcggaaactcagaacactgatccttgctcccacgcgcgtggttgcctctgagatggctgaagccctgaagggaatgcctattcggtaccaaaccacagcggtgaagagcgagcataccggcaaagagatcgtcgacctcatgtgccacgccacattcaccatgagactgctgtcccccgtgcgggtgcctaattataacatgatcattatggatgaagctcattttacggaccccagctctatcgccgctcgcgggtacatttccacaagagtcggcatgggagaggccgccgctatcttcatgaccgcgacccctccgggcagcgttgaagcctttccccagtctaatgctgtgattcaggatgaggaacgggacatccctgagcgcagctggaactccgggtatgagtggatcacagatttccccggaaagaccgtgtggtttgtcccttctattaaaagcggcaatgacatcgccaactgtctcagaaagaatgggaaacgggtgattcagctttccagaaagacattcgataccgaataccaaaagacgaaaaacaacgactgggactacgttgtgacaaccgatatctctgagatgggagccaatttccgcgctgaccgggtcattgatcccagacgctgcctgaagccggtgatcctgaaagacggccctgaacgggttattctcgccgggcccatgcccgtgacagtcgcgagcgctgcccagagacgcggccggatcggaagaaaccacaataaggagggcgatcagtatatctacatggggcagcctctgaacaatgacgaggatcatgcccactggaccgaagctaaaatgcttctggacaacattaatacgcccgagggaatcattcctgccctctttgaaccggagcgcgaaaagtccgcggccatcgatggcgagtatagactgcggggggaggctcgcaagaccttcgtggaactgatgagacggggagacctccccgtctggcttagctacaaagtggcctctgagggctttcaatattccgatcgcagatggtgcttcgacggggaacggaacaatcaggttctggaggaaaacatggatgtggagatttggacaaaggagggcgaaagaaaaaagctgcgccctcggtggctcgacgctagaacctacagcgaccccctggcccttcgcgagtttaaagaattcgctgccggacggagatccgtgtctggcgatctgatcctcgagatcgggaagctgcctcagcacctgacacagcgggcgcaaaatgccctcgacaaccttgtcatgctgcataatagcgaacagggaggccgcgcttatagacacgccatggaggagctgcccgataccattgaaacactcatgctgcttgctctgatcgccgttctcaccgggggagtgacgctgtttttcctgtccggccggggcctcgggaaaacatctattggacttctgtgtgtgatggccagctccgtcctgctctggatggctagcgtggagccgcattggatcgcggcctctattatcctggaatttttccttatggttctgctcatccctgagcccgaccgccagagaacccctcaggataaccaactggcttacgtggtcattggcctgctctttatgatccttaccgtggccgccaatgagatggggctgctggaaacaaccaagaaggacctcggaattggccacgtcgctgtggggaaccaccatcacgccgcgatgctggatgttgaccttcatcccgcctccgcttggacactgtacgccgtggctacgaccatcattacacctatgatgcggcacaccatcgagaacacaaccgccaatattagcctcacggcgatcgccaaccaggctgccatcctgatgggactggataaaggctggcccatttctaagatggacatcggcgtcccgctccttgctctggggtgctattcccaggtgaatcctctgaccctcacagccgctgttctgatgcttgtggcccattacgcgattatcggacccggcctgcaagccaaagctacccgcgaagcccagaagagaacagctgccgggattatgaaaaaccccaccgtcgatggaatcgtggccatcgacctcgatcctgtggtttatgacgcgaagttcgagaagcagctgggccagattatgctgctcatcctttgtacgagccaaattctgctgatgcggacaacctgggctctctgcgaatctatcacactggccaccgggccgcttaccacactgtgggagggaagccccggcaaattttggaatacgaccattgctgtctccatggccaacatcttccgcggctcttacctcgccggggctggactggccttcagcctgatgaagtccctcggcgggggaagacggggcacaggggcgcagggagagacccttggcgaaaaatggaagagacagctgaatcagctgagcaaatccgagtttaacacatataagcgctctggcatcatggaagtggaccggagcgaggccaaggaagggctcaaaagaggagagattaccaagcacgctgtgtcccgcggcacggccaaactgcggtggttcgtcgagagaaatcttgttaagcctgaagggaaagtgatcgatctgggatgtggccgcgggggatggtcttactattgcgctggcctcaagaaggtgacagaggtcaaaggctacaccaaggggggacccggccacgaagagcctattcccatggccacctacgggtggaacctggtgaaactgcatagcggaaaggacgtttttttcgtgcctccggaaaaatgtgatacactcctttgcgacatcggcgagtcctctcccaatcctaccattgaggaagggcggacactgagagtcctgaagatggtggagccctggctccgcggaaaccaattttgtatcaaaattctgaatccttatatgcccagcgttgtggaaacgcttgagcagatgcagcggaagcacggcggcatgctggtcagaaacccgctctcccgcaatagcacccatgagatgtactgggtgtcttgcgggacaggaaacatcgtgtccgcggtcaatatgaccagccggatgctgctgaacagattcacaatggcccaccgcaagcctacctatgaaagagatgttgacctcggcgctgggacgcggcacgtggccgtggagcccgaagtcgctaacctggatatcattggacagcgcatcgagaatattaaacatgaacacaagtctacctggcattacgacgaggataacccctataaaacatgggcctaccacggctcctatgaggtgaagcctagcgggtctgcttccagcatggttaatggagtggtcaaacttctgaccaagccctgggacgtgatccctatggttacacaaattgccatgaccgatacaaccccgtttggccagcagagagtgttcaaggaaaaagtcgacacgcggacacccaaggcgaaaagaggcaccgcccaaatcatggaggtgaccgctaagtggctctgggggtttctgtcccggaacaaaaagcctcgcatctgtacaagagaagagttcacgcggaaggttcgcagcaatgccgctattggagccgtgtttgtcgacgaaaaccagtggaattctgccaaagaggcggtggaggatgaaagattctgggaccttgtccatcgggagcgcgaactgcacaagcagggcaaatgcgctacctgcgtgtacaacatgatggggaagagagagaaaaagctcggagaatttggcaaggccaaagggagccgggccatctggtacatgtggctgggcgctcgcttcctggagttcgaggccctcggatttatgaatgaagatcactggttctccagagagaactctctgagcggcgttgaaggggagggacttcataagctgggctatattctccgggacatctccaaaattcccgggggaaatatgtacgctgatgacacagccggctgggatacccgcatcacagaggacgatctgcagaacgaagcgagaatcaccgacattatggagcctgaacacgcccttctggctaagtctatctttaaactcacatatcaaaataaggtggtccgggtgcagcgccccgccaaaaacgggaccgtgatggatgttattagcagacgggaccagagaggctccggacaggtgggcacgtacgggctgaataccttcacaaacatggaggctcaactgatccgccagatggaatctgagggaatttttagcccgtccgagctcgaaacccctaacctggccgagcgggtccttgattggctggaaaagtatggcgtggagagactcaagcgcatggcgatcagcggggacgactgtgttgtgaaacccatcgatgaccggttcgccacagctctgaccgcccttaatgatatgggaaaggtcagaaaagacattcctcagtgggaaccctctaagggctggaacgattggcagcaagtgcctttttgctcccatcacttccaccagctgatcatgaaagacgggcgcgagattgtcgtgccctgtcggaatcaggatgagctcgttggcagagctcgcgtgagccagggagccggctggtctctgcgggaaacggcttgcctggggaagtcctacgcccaaatgtggcagctcatgtattttcatagacgcgacctgcggcttgcggccaacgctatctgtagcgccgtcccggtggattggattcctacatccagaaccacatggtctatccacgcccatcaccagtggatgaccacggaggacatgctgagcgtttggaatcgggtgtggattgaagagaacccctggatggaagataagacccatatctccagctggggagacgtcccctacctcggcaaaagagaggaccaatggtgcgggtctctgatcggacttacagctcgcgccacctgggcgacaaatattcaggtggctatcaaccaggtgcggagactgattggcaatgagaactacctcgattatatgacctccatgaagcgcttcaaaaatgaaagcgaccctgagggggccctgtggtga

SEQ ID NO: 18568 - RNA, 9879 nt, synthetic construct
  misc_feature 1..9879: note = derived and/or modified CDS sequence (opt5) from DENV-1__FJ639690__SS-prME
  source 1..9879: mol_type = other RNA
agcgtgaccatgctgctcatgctgatgcccacagcccttgctttccacctgacgatcagaggcggggagcctcatatgattgtctccaagcaggaacggggaaaatctctcctgtttaagaccagcgccggcgttaacatgtgcacacttatcgcgatggacctgggggagctctgtgaagataccatgacatacaaatgcccgcgcattaccgaggctgaacccgacgatgtggactgttggtgcaatgccacagatacctgggtgacgtatggaacctgttcccaaatcggcgagcacagacgggacaagcgctctgtcgccctggctcctcatgtggggctgggactcgagacaagaaccgaaacatggatgagctccgagggcgcctggaaacagattcagcgggttgaaacctgggctctgcgccaccccggcttcacggtgatcgccctttttctggcgcatgccatcgggacatctattacccagaagggaatcattttcatcctcctgatgcttgtcacacctagcatggctatgagatgcgtgggcattgggtcccgggattttgttgagggactgagcggcgccacctgggtggacgtcgtgctcgagcacgggtcttgtgtgaccacaatggctaaggataaacccacgctggacatcgaactgctcaagaccgaggtcacaaaccctgccattctgcgcaaactttgcatcgaagcgaagatctccaataccacaaccgatagcagatgtccgacgcaaggagaggccacactggttgaagagcaggacgctaacttcgtgtgccggcgcacctttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgaccgtccacacaggcgaccagcatcaagtggggaatgagagcacggaacacggaaccacagctaccatcacaccccaggcccctaccacggagattcagctcaccgactacggcgccctgacactggattgttctccccggaccggcctcgacttcaacgaaatggttctgcttacaatgaaggagaaatcctggctggtgcataagcagtggtttctcgatctgcctcttccctggaccagcggggcttccacgtctcaagagacatggaatcgccaggacctgctcgtcaccttcaaaacagcgcacgccaagaagcaggaagtggtcgtgctgggaagccaagagggcgctatgcacaccgccctgaccggggccacagaaatccagacgtccggaaccacaaccatctttgctggccatctcaaatgcagactgaagatggataaacttacactgaaggggatgagctatgttatgtgtaccggctctttcaaactcgagaaggaagtggccgagacgcagcacggaacagtcctggtgcagattaagtacgagggcaccgacgcgccgtgcaaaatccctttctccacccaagatgaaaagggggttacacagaacggacggctgattaccgctaatcccatcgtgacagacaaagagaagcctgtcaacattgaagccgagcccccctttggcgagagctatatcgtgatcggggccggagaaaaagctcttaagctctcttggttcaagaaaggcagctccattgggaagatgtttgaggccacggctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacaatgaagattgggatcggcgtcctgcttacctggctgggactcaattctagatccacgagcttctctatgacctgtattgccgtgggcctggttacactgtaccttggggtgatggtccaggctgattccggatgcgtgatcaactggaaaggccgcgaactcaagtgtgggagcggaatctttgttaccaatgaggtgcacacatggaccgaacaatataagttccaggccgactcccctaaacggctgtctgcggccattggcaaggcttgggaggagggggtctgcggcatcagaagcgccacacgcctggaaaacattatgtggaaacagatctccaacgagctcaatcatattctgcttgaaaacgacatgaagtttaccgtggttgtgggagatgtcgctggcatcctggcccaggggaaaaagatgatccggccgcaacccatggagtacaaatattcttggagaagctggggaaaggccaagattatcggcgctgacgtgcagaatacgacattcattatcgatgggcctaacacccccgaatgtcctgacgatcagcgcgcgtggaatatttgggaggtggaggactacggatttggcatcttcaccacaaacatctggctcaaactgcgggattcctatacccaggtctgcgaccacagactgatgagcgccgctattaaggattctaaagccgttcacgccgacatgggctactggatcgaatccgagaagaatgaaacgtggaaacttgctcgcgccagcttcattgaggtgaagacatgtgtgtggcccaagtctcataccctctggtccaacggggtcctggaaagcgagatgatcattccgaaaatctatggaggccctatctctcaacacaattaccggcccgggtactttacacagaccgcgggaccttggcatctgggcaagctcgagctggatttcgacctttgcgaagggacaaccgtggttgtggatgagcactgcggaaacagaggccccagcctgcggacgaccacagtcaccggcaaaattatccacgaatggtgttgccgctcctgtacactccctcccctgagatttcggggggaggacggatgctggtatggcatggagattagaccggtgaaggaaaaagaggaaaatctggttaagagcatggtgtctgctgggtccggagaggtcgacagcttctcccttggcctcctgtgtatctctattatgaccgaagaggtgatgcgcagccggtggtccagaaagatgctgatgacggggacactcgccgtttttctgcttctgatcatgggacagctcacctggaacgatctgattcgcctgtgcatcatggtgggcgccaatgcttctgacagaatgggcatggggacaacctaccttgccctgatggcgaccttcaaaatgcggcctatgtttgctgtcggactcctgttccgcagactcacaagccgggaggtgctgcttctgacggtgggcctctccctggtcgcctctgttgaactgcccaacagccttgaggaactgggggatggactcgccatgggcatcatgattctgaagctcctgaccgactttcaaccccatcagctttgggctacactgctctccctgaccttcatcaaaacaacctttagcctgcactatgcctggaagacgatggctatggtgctttctattgtgtccctgttccctctctgtctgagcacaacctctcagaaaaccacatggctcccggtcctgcttgggtccctgggatgcaagcccctgaccatgtttctcatcgccgagaataagatttggggccgcagaagctggcctctgaacgaaggcatcatggcggtggggatcgtttctattcttctgtccagcctcctgaaaaacgatgtgcccctcgccggacctctgatcgctggcgggatgcttattgcctgttacgtcatctccggaagctctgctgacctgagcctggagaaggccgccgaggtgtcctgggaagaggaagctgagcattctggcgcgagccacaatattctcgttgaagtgcaggatgacgggacaatgaaaatcaaggatgaggagcgggacgatacgctgaccatccttctgaaagccacactcctggctgtctccggagtgtatcccctctctattcctgccaccctgttcgtctggtacttctggcaaaagaaaaagcagcgcagcggcgtgctttgggacacaccctccccgcctgaagttgagagagccgtgctggatgacggcatctatcggattatgcagcgcgggctgctcggaagatctcaggtcggcgtgggggtttttcaagaaaacgtgttccataccatgtggcacgtcacgcggggagctgtgctgatgtaccagggcaagagacttgagcccagctgggcctccgtgaaaaaggacctgatcagctacgggggaggctggcgcctccagggctcttggaataccggggaggaagttcaggtcattgcggtggagcctggaaaaaaccccaagaatgtgcaaacagctccgggcacctttaaaacacctgaaggggaggtcggagccatcgccctggatttcaagcccggcacctccgggagccctattgtgaaccgggaaggaaagatcgttggcctctatggcaatggggtggtcacaacgtctggaacctacgtgtccgctatcgcccaggcgaaagctagccaggagggccccctgcccgagattgaagacgaggtttttagaaagcgcaaccttacaatcatggatctgcaccctgggtccggaaaaacccggagatatctgccggccattgtgcgcgaagccatcaagcggaaactcagaaccctgattcttgctcccacacgcgtcgtggcctctgagatggctgaagccctgaagggcatgcctatccggtaccaaacgaccgcggttaagagcgagcatacagggaaagagatcgtggacctcatgtgccacgccaccttcacaatgagactgctgtcccccgtccgggtgcctaattataacatgattatcatggatgaagctcattttaccgaccccagctctattgccgctcgcggctacatctccacgagagtgggaatgggcgaggccgccgctattttcatgacagcgacccctccggggagcgtcgaagcctttccccagtctaatgctgttatccaggatgaggaacgggacatccctgagcgcagctggaactccggatatgagtggattaccgatttccccggcaagacagtgtggtttgtgccttctatcaaaagcgggaatgacattgccaactgtctcagaaagaatggaaaacgggtcatccagctttccagaaagaccttcgatacagaataccaaaagaccaaaaacaacgactgggactacgtggttacgacagatatttctgagatgggcgccaatttccgcgctgaccgggtgatcgatcccagacgctgcctgaagccggtcattctgaaagacgggcctgaacgggtgatcctcgccggccccatgcccgttaccgtggcgagcgctgcccagagacgcggacggatcggcagaaaccacaataaggagggggatcagtatatttacatgggacagcctctgaacaatgacgaggatcatgcccactggacagaagctaaaatgcttctggacaacatcaatacccccgagggcattatccctgccctctttgaaccggagcgcgaaaagtccgcggccattgatggggagtatagactgcggggagaggctcgcaagacgttcgtcgaactgatgagacggggcgacctccccgtgtggcttagctacaaagtcgcctctgaggggtttcaatattccgatcgcagatggtgcttcgacggcgaacggaacaatcaggtgctggaggaaaacatggatgttgagatctggaccaaggagggagaaagaaaaaagctgcgccctcggtggctcgacgctagaacatacagcgaccccctggcccttcgcgagtttaaagaattcgctgccggccggagatccgtgtctggggatctgatcctcgagattggaaagctgcctcagcacctgacccagcgggcgcaaaatgccctcgacaaccttgtgatgctgcataatagcgaacagggcgggcgcgcttatagacacgccatggaggagctgcccgatacaatcgaaaccctcatgctgcttgctctgattgccgtcctcacaggaggcgttaccctgtttttcctgtccggccgggggctcggaaaaacgtctatcggccttctgtgtgtgatggccagctccgtgctgctctggatggctagcgtcgagccgcattggattgcggcctctatcatcctggaatttttccttatggtgctgctcattcctgagcccgaccgccagagaacacctcaggataaccaactggcttacgttgtgatcgggctgctctttatgattcttaccgtcgccgccaatgagatgggactgctggaaaccacaaagaaggacctcggcatcgggcacgtggctgtcggaaaccaccatcacgccgcgatgctggatgtggaccttcatcccgcctccgcttggaccctgtacgccgttgctacaacgattatcacccctatgatgcggcacacaattgagaacaccacagccaatatcagcctcaccgcgatcgccaaccaggctgccattctgatgggcctggataaaggctggcccatctctaagatggacattggggtgccgctccttgctctgggatgctattcccaggtcaatcctctgacgctcaccgccgctgtgctgatgcttgttgcccattacgcgatcattggccccgggctgcaagccaaagctacacgcgaagcccagaagagaaccgctgccggaatcatgaaaaaccccacagtggatggcatcgtcgccattgacctcgatcctgtggtgtatgacgcgaagttcgagaagcagctggggcagatcatgctgctcattctttgtaccagccaaatcctgctgatgcggacgacatgggctctctgcgaatctattaccctggccacaggaccgcttaccaccctgtgggagggcagccccggcaaattttggaatacaacgatcgctgtttccatggccaacatcttccgcgggtcttacctcgccggagctggcctggccttcagcctgatgaagtccctcgggggaggcagacgggggaccggagcgcagggcgagacacttggcgaaaaatggaagagacagctgaatcagctgagcaaatccgagtttaacacctataagcgctctgggattatggaagtcgaccggagcgaggccaaggaaggactcaaaagaggcgagatcacaaagcacgctgtgtcccgcgggaccgccaaactgcggtggttcgtggagagaaatcttgtcaagcctgaaggaaaagttattgatctgggctgtgggcgcggaggctggtcttactattgcgctggcctcaagaaggtgacggaggtgaaagggtacacaaagggaggccccgggcacgaagagcctatccccatggccacctacggatggaacctggtcaaactgcatagcggcaaggacgtgtttttcgttcctccggaaaaatgtgataccctcctttgcgacattggggagtcctctcccaatcctacaatcgaggaaggacggaccctgagagtgctgaagatggtcgagccctggctccgcggcaaccaattttgtattaaaatcctgaatccttatatgcccagcgtggttgaaacacttgagcagatgcagcggaagcacggcgggatgctggtgagaaacccgctctcccgcaatagcacgcatgagatgtactgggtctcttgcggaaccggcaacatcgtgtccgcggtgaatatgacaagccggatgctgctgaacagattcaccatggcccaccgcaagcctacatatgaaagagatgtcgacctcggggctggaacccggcacgttgccgtggagcccgaagtggctaacctggatattatcggccagcgcattgagaatatcaaacatgaacacaagtctacgtggcattacgacgaggataacccctataaaacctgggcctaccacgggtcctatgaggtcaagcctagcggatctgcttccagcatggtgaatggcgttgtgaaacttctgacaaagccctgggacgtcattcctatggtgacccaaatcgccatgacagataccacaccgtttggccagcagagagttttcaaggaaaaagtggacacccggacgcccaaggcgaaaagagggacagcccaaatcatggaggtcaccgctaagtggctctggggatttctgtcccggaacaaaaagcctcgcatttgtaccagagaagagttcacacggaaggtgcgcagcaatgccgctatcggcgccgtttttgtggacgaaaaccagtggaattctgccaaagaggcggtcgaggatgaaagattctgggaccttgtgcatcgggagcgcgaactgcacaagcaggggaaatgcgctacgtgcgtctacaacatgatgggaaagagagagaaaaagctcggcgaatttgggaaggccaaaggcagccgggccatttggtacatgtggctgggagctcgcttcctggagttcgaggccctcggctttatgaatgaagatcactggttctccagagagaactctctgagcggggtggaaggagagggccttcataagctggggtatatcctccgggacatttccaaaatccccggaggcaatatgtacgctgatgacaccgccgggtgggatacacgcatcaccgaggacgatctgcagaacgaagcgagaattacagacatcatggagcctgaacacgcccttctggctaagtctatttttaaactcacctatcaaaataaggttgtgcgggtccagcgccccgccaaaaacggcacagtgatggatgtgatcagcagacgggaccagagaggatccggccaggttgggacctacggactgaatacgttcaccaacatggaggctcaactgattcgccagatggaatctgagggcatctttagcccgtccgagctcgaaacacctaacctggccgagcgggtgcttgattggctggaaaagtatggggtcgagagactcaagcgcatggcgatcagcggagacgactgtgtggttaaacccattgatgaccggttcgccaccgctctgacagcccttaatgatatgggcaaggtgagaaaagacatccctcagtgggaaccctctaaggggtggaacgattggcagcaagtccctttttgctcccatcacttccaccagctgattatgaaagacggccgcgagatcgtggtcccctgtcggaatcaggatgagctcgtgggaagagctcgcgttagccagggcgccgggtggtctctgcgggaaaccgcttgcctgggaaagtcctacgcccaaatgtggcagctcatgtattttcatagacgcgacctgcggcttgcggccaacgctatttgtagcgccgtgccggtcgattggatccctacgtccagaacaacctggtctattcacgcccatcaccagtggatgacaaccgaggacatgctgagcgtgtggaatcgggtttggatcgaagagaacccctggatggaagataagacgcatatctccagctggggcgacgtgccctacctcgggaaaagagaggaccaatggtgcggatctctgattggccttaccgctcgcgccacatgggcgaccaatatccaggtcgctattaaccaggtgcggagactgatcgggaatgagaactacctcgattatatgacatccatgaagcgcttcaaaaatgaaagcgaccctgagggcgccctgtggtga

SEQ ID NO: 18569 - RNA, 9879 nt, synthetic construct
  misc_feature 1..9879: note = derived and/or modified CDS sequence (opt5) from DENV-1__FJ639691__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatcttatcagctgtgggctacgcttctgtccctcacctttatcaaaacaaccttcagcctgcattacgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttatgtgatcagcggatcctctgctgaccttagcctggagaaagccgccgaggtctcctgggaagaggaagctgagcactctggcgcgagccataatattctggtggaagttcaggatgacgggacaatgaagatcaaagatgaggagcgggacgataccctcacaatcctgcttaaggccacgctgctcgctgtgtccggagtctaccctctgtctattcccgccaccctcttcgtgtggtatttttggcaaaagaaaaagcagcgcagcggcgtcctgtgggacacacctagccctcccgaagtggagagagccgttcttgatgacggcatctaccggattatgcagcgcgggctgctgggaagaagccaggtgggcgtcggggtgttccaagaaaacgtttttcacaccatgtggcatgtgacacggggagctgtcctcatgtaccagggcaaacgcctggagccctcttgggcctccgtgaagaaagaccttatcagctatgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtacggcaatggggttgtgacaacctctggaacatatgtcagcgctatcgcccaggcgaaggcttcccaggagggccccctccctgagattgaagacgaggtgttcagaaaacgcaacctgacgatcatggatcttcaccccgggagcggaaagacccggagatacctgcccgccattgttcgcgaagccatcaagcggaaactgagaacactcattctggctcctacccgcgtggtcgcctctgagatggctgaagcccttaagggcatgccgatccggtatcaaaccacagcggtgaaatccgagcacacggggaaggagatcgttgacctgatgtgccatgccacctttacaatgagactcctgagccccgtgcgcgtccctaattacaacatgattatcatggatgaagctcacttcaccgacccctctagcattgccgctcggggctatatctccacaagagtgggaatgggcgaggccgccgctatttttatgaccgcgacgcctcccgggtctgtggaagccttccctcagagcaatgctgtcatccaggatgaggaacgggacatcccggagcgctcctggaactctggatacgagtggattacagattttcccggcaaaaccgtttggttcgtgcctagcatcaagtccgggaatgacattgccaactgtctgagaaagaatggaaaacgggtgatccagctcagccgcaagaccttcgatacagaataccagaagaccaagaacaacgactgggactatgtcgtgacaaccgatatttctgagatgggcgccaattttagagctgaccgggttatcgatcccagacgctgccttaaacctgtgattctgaaggacgggcccgaacgggtcatcctggccggcccgatgcctgtgacggttgcgtccgctgcccagagacgcggacggatcggcagaaaccataataaggagggggatcagtacatttatatgggacagcccctcaacaatgacgaggatcacgcccattggacagaagctaaaatgctgcttgacaacatcaatacccccgagggcattatccctgccctgttcgaacccgagcgcgaaaagagcgcggccattgatggggagtaccggctcagaggagaggctcgcaaaacatttgtggaactgatgagacggggcgacctgcctgtctggctctcctataaggtggcctctgaggggttccaatacagcgatcgcagatggtgctttgacggcgaacggaacaatcaggtccttgaggaaaacatggatgtggagatctggaccaaagagggagaacgcaagaaactgagaccgcggtggctggacgctagaacgtattccgaccccctcgccctgcgcgagttcaaggaatttgctgccggccggagatctgttagcggggatcttatcctggagattggaaagctccctcagcacctgacccagcgcgcgcaaaatgccctggacaacctcgtgatgcttcacaattccgaacagggcgggcgggcttacagacatgccatggaggagctgcccgatacaatcgaaaccctgatgctcctggctcttattgccgtgctgacaggaggcgtcaccctcttctttctgagcggccgggggctgggaaaaacatctatcggcctcctttgtgttatggcctccagcgtgctgctgtggatggcttctgtggagcctcactggattgcggcctccatcatcctcgagttctttctgatggtccttctgattcccgagccggaccgccagagaacccctcaggataaccaactcgcttacgtggttatcgggctgctgttcatgattctcacggtggccgccaatgagatgggacttctggaaacaaccaagaaagacctgggcatcgggcatgtcgctgtggagaaccaccaccatgccgcgatgctcgatgtcgacctgcaccccgccagcgcttggaccctttatgccgtggctacaaccattatcacacctatgatgcggcatacgattgaaaacaccacagccaatatctctctgaccgcgatcgccaaccaggctgccattctcatgggactggataagggctggcccatcagcaaaatggacattggcgttcctctgctcgctcttgggtgctactcccaggtgaatcccctgacactgaccgccgctgtcctcatgctggtggcccactatgcgatcattggaccgggccttcaagccaaggctacgcgcgaggcccagaagagaaccgctgccgggatcatgaaaaaccctacagttgatggaatcgtggccattgacctggatcccgtcgtgtacgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgtgagcatggccaacatcttccgcggctcctatctggccggggctggactcgccttttctctgatgaaaagcctgggcgggggaagacggggcacaggggcgcagggagaaacgctcggcgagaagtggaagcgccagcttaatcagctgtccaaatctgagttcaacacctacaagagaagcggcattatggaggttgaccggtccgaagccaaagaggggctgaagagaggagagacaaccaaacatgctgtctctcgcggcacagccaagctccggtggtttgtggaaagaaatctggtgaagccggaggggaaagtcatcgatcttggatgtggccgcgggggatggagctattactgcgctggcctgaagaaagttaccgaagtgaagggctacacgaaagggggacccggccacgaggaacctattcccatggccacatatgggtggaacctcgtgaagctgcactccggaaaagacgtcttctttgtgcctcccgagaagtgtgataccctgctctgcgacatcggcgagagctctcctaatccgaccattgaagaggggcggacacttagagttctgaagatggtggaaccctggctgcgcggaaaccaattctgtatcaaaattctcaatccttacatgccctccgtcgtggagaccctggagcagatgcagcggaagcatggcggcatgcttgttagaaaccctctgagccgcaattctacacacgaaatgtattgggtgtcctgcgggacgggaaacatcgtcagcgcggtgaatatgacctctcggatgctcctgaacagatttacaatggcccatcgcaaacccacctacgagcgggatgtggacctgggcgctgggacaagacacgtcgccgttgaaccggaggtggctaacctcgatatcattggacagcgcatcgaaaatattaagcacgagcataaatccacctggcactatgacgaggataacccttacaagacgtgggcctatcatggcagctacgaagtgaagccctccgggagcgcttctagcatggtcaatggagtggttaaactgcttaccaagccctgggacgtgatccctatggtcacacaaattgccatgaccgatacaacccccttcggccagcagagagtgtttaaagagaaggttgacacacggacccctaaagcgaagcgcggcacggcccaaatcatggaagtgacagctaagtggctgtgggggttcctctccagaaacaaaaagccgcggatctgtaccagagaggaatttacccggaaagtccgctctaatgccgctattggagccgtgttcgttgacgagaaccagtggaatagcgccaaggaggcggtggaagatgagagattttgggacctggtccaccgggaacgcgagcttcataaacagggcaagtgcgctacatgcgtgtacaacatgatggggaagagagagaagaagctgggagagttcggcaaagccaaggggtcccgggccatctggtatatgtggctcggcgctcgcttcctggagtttgaagccctgggattcatgaatgaggatcactggttttctagagaaaacagcctctccggcgtcgagggggagggactgcacaaacttggctacattctgcgggacatctctaagattagcgggggaaatatgtatgctgatgacacggccggctgggatacccgcatcacagaagacgatctccagaacgaggcgaaaatcaccgacattatggaacccgagcatgccctgcttgctaagtccatcttcaagctgacataccaaaataaagtggttagagtgcagcggcctgccaagaacgggaccgtcatggatgtgattagccgcagagaccagcggggctctggacaggtgggcacatatgggctcaatacctttacgaacatggaagctcaactgatccgccagatggagtccgagggaattttcagcccctctgaactggagacccctaacctcgccgaaagaacactggattggcttgagaaacacggcgttgaacggctgaagagaatggcgatctccggggacgactgtgtggtcaaacccatcgatgaccgctttgccaccgctctcacagccctgaatgatatgggaaaggtgcggaaggacattccgcagtgggagcctagcaaaggctggaacgattggcagcaagttcccttctgctcccatcactttcaccagcttatcatgaaggacgggagagagattgtggtcccttgtcgcaatcaggatgaactggtgggccgggctagagtctctcagggagccggctggagcctccgcgagaccgcttgcctggggaaatcctacgcccaaatgtggcagctgatgtatttccatcggagagacctccgcctggcggccaacgctatctgtagcgccgtgcccgttgattgggtgcctacgtctcggacaacctggtccattcacgcccatcaccagtggatgacaaccgaagacatgcttagcgtctggaatagagtgtggatcgaggaaaacccctggatggaggataagacgcatatttctagctgggaggacgttccgtacctgggaaaacgcgaagaccaatggtgcggctccctcatcgggctgaccgctcgggccacatgggcgaccaatatccaggtggctattaaccaggtcagacggcttatcggaaatgagaactacctggattatatgacatctatgaagagatttaagaatgaaagcgacctcgagggcgccctgtggtga

SEQ ID NO: 18570 - RNA, 9879 nt, synthetic construct
  misc_feature 1..9879: note = derived and/or modified CDS sequence (opt5) from DENV-1__FJ639692__SS-prME
  source 1..9879: mol_type = other RNA
agcgtgaccatgctgctcatgctgatgcccaccgcccttgctttccacctgacgaccagaggcggggagcctcatatgatcgtctccaagcaggaacgggggaaatctctcctgtttaagaccagcgccggcgttaatatgtgcacccttatcgcgatggacctgggggagctctgtgaagatacgatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagtctgcctggaaacagattcagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtggactcttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcagcacccaagatgaaaagggcgttacacagaacgggcggctgattacggctaatcccatcgtgaccgacaaagagaagcctgtcaacattgaagccgagccgccctttggagagtcttatatcgtgattggcgccggggaaaaagctcttaagctcagctggttcaagaaaggatcctctatcggcaagatgtttgaggccacagctagaggggcccgccggatggcgatcctgggcgataccgcctgggacttcggaagcattggcggggtgtttacatccgttggaaaactggtccatcagatcttcggcaccgcttacggggtgctctttagcggagtgtcttggacgatgaagattggcatcggggtcctgcttacctggctgggcctcaattccagaagcacatctctgtccatgacctgtattgccgtgggactggttacactttacctcggcgtgatggtccaggctgatagcgggtgcgtgatcaactggaaaggacgcgaactgaagtgtggctccgggattttcgttaccaatgaggtgcacacatggaccgaacaatataagtttcaggccgactctcctaaacggctgagcgcggccatcggaaaggcttgggaggagggcgtctgcgggatcagatccgccacgcgcctcgaaaacattatgtggaaacagatctctaacgagctgaatcatattcttctggaaaacgacatgaagttcacagtggttgtgggcgatgtcgctggaatcctcgcccagggcaaaaagatgattcggccgcaacccatggagtacaaatatagctggaagtcctgggggaaggccaaaatcatcggagctgacgtgcagaataccacctttattatcgatggccctaacacacccgaatgtcctgacgatcagagagcgtggaatatttgggaggtggaggactacgggttcggaatctttaccacgaacatttggctgaagctgcgcgatagctatacacaggtctgcgaccaccggcttatgtctgccgctatcaaagattccaaggccgttcacgccgacatgggctactggatcgaaagcgagaaaaatgaaacctggaagctcgctagagcctctttcattgaggtgaagacatgtatctggcccaaatcccataccctgtggagcaacggcgtgctggaatctgagatgattatcccgaagatttatgggggacctatcagccaacacaattaccgccccggctacttcacacagaccgcggggccttggcatctcggaaaactggagcttgattttgacctgtgcgaaggcacgaccgtcgtggttgatgagcactgcgggaaccggggaccctccctcagaacaaccacagtgaccggcaagatcattcacgaatggtgttgccggagctgtacgctgcctcccctgcgcttcagaggcgaggacgggtgctggtatggaatggagatccggccggtcaaagaaaaggaggaaaatcttgtgaagtctatggtttccgctggcagcggggaggtggactccttttctctcggactgctgtgtattagcatcatgattgaagaggtcatgagatcccgctggtctcggaaaatgctcatgacaggcaccctggccgtgttccttctgctcatcatggggcagctgacatggaacgatctgattagactttgcatcatggttggagccaatgctagcgaccgcatgggcatgggcaccacctacctggccctcatggcgacatttaagatgagacctatgttcgctgtggggctgctctttcggcgcctgacgtccagagaggtccttctgctcaccatcggactgtctctggtggccagcgtggaacttcccaactccctggaggaactcggcgatgggctggccatgggaattatgatcctcaaactgcttacagacttccaaagccatcagctgtgggctaccctcctgtctctgacatttattaagaccacgttctcccttcactatgcctggaaaacaatggctatggtcctgagcatcgtttctctctttcccctgtgtctctccaccaccagccagaagacaacctggctgcctgtgcttctgggctctctggggtgcaagccgctcacaatgttcctgattgccgagaataaaatctggggacggcgctcctggccccttaacgaaggcatcatggcggtgggcattgtcagcatcctgctctccagcctgctcaagaacgatgtgcctctggccgggccccttattgctggaggcatgctgatcgcctgttacgttatttctgggagctccgctgacctgtctctcgagaaagccgccgaggtgagctgggaagaggaagctgagcattccggagcgtctcacaatatcctggtcgaagtgcaggatgacggcacgatgaagatcaaagatgaggagagagacgatacccttacaattctgctcaaggccaccctgctcgctgttagcggggtgtatcctctgtccatccccgccacactttttgtctggtacttctggcagaagaagaagcagcggtctggagtgctgtgggacaccccttcccctcccgaagtcgagcgcgccgtgctggatgacggcatttatagaatcatgcagcggggcctcctggggcgctcccaggttggagtgggcgtcttccaagaaaacgtgtttcatacgatgtggcacgttaccagaggggctgtgcttatgtaccagggaaaacggctggagcccagctgggcctctgtcaagaaagacctcatttcctacggcgggggatggagactgcagggcagctggaatacaggcgaggaagtgcaagtgatcgcggttgagcccgggaagaaccctaaaaatgtccaaaccgctcccggaacattcaagaccccggaaggcgaggtgggggccattgccctcgattttaagcctggaacatctggctcccccatcgtgaaccgcgaagggaaaatcgtcggactgtatggcaatggcgtggttacgaccagcgggacatacgtgtccgctattgcccaggcgaaggcttctcaggagggacctcttcccgagatcgaagacgaggtcttccggaaaagaaacctgaccattatggatctgcaccccggcagcgggaagacccgccggtatctccctgccatcgtgagagaagccattaaacgcaagctgcggacacttatcctggctccgacgagagttgtggcctccgagatggctgaagccctcaagggaatgcccatccgctaccaaaccacagcggtcaaaagcgagcataccggcaaggagattgtggacctgatgtgccacgccacatttaccatgcggctgctctctcctgttagagtgcccaattataacatgatcattatggatgaagctcatttcacggacccttccagcatcgccgctcgggggtacatttctacacgcgtcggcatgggagaggccgccgctatctttatgaccgcgacaccccctggcagcgtggaagccttcccgcagtccaatgctcttatccaggatgaggaaagagacattcccgagcggtcttggaacagcgggtatgagtggatcacagattttcctggaaaaaccgtgtggttcgtcccctccattaagtctggcaatgacatcgccaactgtctgcgcaaaaatgggaagagagttattcagctgagccggaagacatttgataccgaataccagaaaacgaagaacaacgactgggactacgtggtgacaaccgatatctccgagatgggagccaatttcagagctgaccgcgtcattgatcctcggagatgcctcaaacccgtgatcctgaaggacggcccggaacgcgttatccttgccgggcctatgcccgtgacagtcgcgagcgctgcccagcggagaggccgcattggacggaaccacaataaagagggcgatcagtatatctacatggggcagcccctgaacaatgacgaggatcatgcccactggaccgaagctaagatgctcctggacaacattaatacgcctgagggaatcattcccgccctgttcgaacctgagagagaaaagtctgcggccatcgatggcgagtatcgcctcagaggggaggctcggaaaacctttgtggaacttatgcgcagaggagacctgccggtttggctgtcctacaaggtggccagcgagggcttccaatattccgatcggcgctggtgctttgacggggaaagaaacaatcaggtcctcgaggaaaacatggatgtggagatctggacaaaagagggcgaacggaagaaactgagaccccgctggcttgacgctcggacctactctgaccctctggccctcagagagttcaaggaatttgctgccggacgccggagcgtctccggcgatctgattctggagatcgggaaactcccccagcaccttacacagagagcgcaaaatgccctggacaacctggtgatgctccataattctgaacagggaggccgggcttatcgccacgccatggaggagctgcctgataccattgaaacacttatgctgctcgctctgatcgccgttctgaccgggggagtgacactcttctttcttagcggcagaggcctggggaagacatccattggactgctctgtgtgatggccagctctgtcctgctttggatggcttccgttgagccccattggatcgcggccagcatcattctggagttctttctcatggtgctgctgatcccggagcctgaccggcagcgcacaccccaggataaccaactcgcttacgtggtcattggccttctgttcatgatcctgaccgtggccgccaatgagatggggctcctggaaacaaccaagaaagaccttggaattggccacgttgctgtggggaaccaccatcacgccgcgatgctggatgtcgacctccatcctgcctctgcttggacactgtacgccgtggctacgaccatcattacacccatgatgagacacaccatcgagaacacaaccgccaatatctccctgacggcgattgccaaccaggctgccatcctcatgggacttgataagggctggcctattagcaaaatggacatcggcgtccccctgctggctctcgggtgctattctcaggtgaatccgctgacccttacagccgctgttctgatgctcgtggcccattacgcgattatcggacctggcctgcaagccaaggctacccgggaagcccagaaacgcacagctgccgggatcatgaagaaccccaccgtcgatggaattgtggccatcgacctggatcccgttgtgtatgacgcgaagtttgagaaacagctcggccagattatgcttctgatcctgtgtacgagccaaattctcctgatgagaacaacctgggctctttgcgaatccatcacactggccaccgggcctctcaccacactgtgggagggatctccgggcaagttctggaatacgaccatcgctgtcagcatggccaacatttttcggggctcctacctggccggggctggactcgccttcagccttatgaaatccctgggcgggggacgcagaggcacaggggcgcagggagagaccctgggcgaaaagtggaaacggcagctcaatcagctgtctaagagcgagttcaacacatataagagatccggcatcaccgaagtggaccgctctgaggccaaagaagggcttaagcggggagagacgacaaaacacgctgtgagcagaggcaccgccaagctgcgctggtttgttgagcggaatctcgtcaaacccgaagggaaggtgattgatctgggatgtggcagagggggatggtcctactattgcgctggcctgaagaaagtgaccgaggtcaagggctacacaaaagggggacctggccacgaagaacccatccctatggccacctacgggtggaacctcgttaaacttcattctggaaaagacgtgttctttattccccctgaaaagtgtgatacactgctgtgcgacatcggcgagagctccccgaatcccacgattgaggaagggcgcaccctccgggtgctgaaaatggtcgagccttggcttagaggaaaccaattctgtatcaagatcctgaatccctatatgcctagcgtggttgaaacactcgagcagatgcagcgcaagcacggcggcatgctggtgcggaaccccctgtctagaaattccacccatgagatgtactgggtcagctgcgggacaggaaacattgtgtctgcggttaatatgacctcccgcatgctcctgaaccggtttacgatggcccacagaaaaccgacctatgaacgcgatgtggaccttggcgctgggacaagacacgtcgccgtggagcctgaagtggctaacctggatatcattggacagcggatcgagaatattaagcatgaacacaaaagcacctggcattacgacgaggataacccctataagacatgggcctaccacggctcttatgaggtcaaaccctccgggagcgcttccagcatggttaatggagtggtgaagctcctgaccaagccttgggacgtcatccccatggtgacacaaatcgccatgaccgatacgacacctttcggccagcagcgcgtttttaaagaaaaggtggacaccagaaccccgaaagcgaagcggggcacagcccaaattatggaggtcacggctaaatggctttgggggttcctgtctagaaacaagaagccccggatctgtacccgcgaagagtttacaagaaaagtgcggagcaatgccgctattggagccgttttcgtggacgaaaaccagtggaactccgccaaggaggcggtcgaggatgaacgcttttgggacctcgtgcatagagagcgggaactgcacaaacagggcaagtgcgctacctgcgtttacaacatgatggggaaacgcgagaagaagctgggagagttcggcaaagccaaggggtctagagccatctggtacatgtggctcggcgctcggtttctggagttcgaggcccttggattcatgaatgaagatcactggtttagccgcgagaactccctgtctggcgtggaaggggagggactccataaactgggctatattcttagagacatcagcaagatccctgggggaaatatgtacgctgatgacacagccggctgggatacccggattacagaggacgatctgcagaacgaagcgcgcatcaccgacattatggagcccgaacacgccctcctggctaaatccatcttcaagctgacgtatcaaaataaagtcgtgagagtccagcggcctgccaagaacgggaccgtgatggatgttatttctcgcagagaccagcggggcagcggacaggtgggcacatacgggctcaatacctttacaaacatggaggctcaactgatcagacagatggaatccgagggaatcttcagcccctctgagcttgaaaccccgaacctggccgagcgcgtcctcgattggctggaaaagtatggcgtggagcggcttaaaagaatggcgatttccggggacgactgtgtggttaagcctatcgatgaccgctttgccacggctctgacagccctcaatgatatgggaaaagtgcggaaggacattccccagtgggaacctagcaaaggctggaacgattggcagcaagtccccttctgctctcatcactttcaccagctgatcatgaaggacgggagagagattgtggttccttgtcgcaatcaggatgagctggtgggccgggctagagtctcccagggagccggctggagcctccgcgaaaccgcttgcctggggaagtcctacgcccaaatgtggcagcttatgtatttccatcggagagacctgcgcctcgcggccaacgctatctgttctgccgtgcccgtcgattggattccgacaagccggaccacgtggtccatccacgcccatcaccagtggatgaccacagaggacatgctgagcgtgtggaatagagtttggatcgaagagaacccttggatggaagataaaacccatatttcttcctggggagacgtgccctaccttggcaagcgggaggaccaatggtgcgggagcctgatcggactcacagctagagccacctgggcgacaaatattcaggtcgctatcaaccaggtgcgccggctgattggcaatgagaactacctggattatatgacctctatgaaaagatttaagaatgaaagcgaccccgagggggccctctggtga

SEQ ID NO: 18571 - RNA, 9879 nt, synthetic construct
  misc_feature 1..9879: note = derived and/or modified CDS sequence (opt5) from DENV-1__FJ639693__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaagtctctcctgtttaagacaagcgccggcgttaacatgtgcacccttattgccatggacctgggggagttctgtgaagatacaatgacctacaagtgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgccgaggctttccctcagagcaatgccgtgatccaggatgaagaacgggacatcccggagcgctcctggaactctggatatgagtggattacagattttcccggcaaaaccgtctggttcgttcctagcatcaagtccgggaatgacattgccaactgtctgagaaagaatggaaaacgggtgatccagctcagccgcaagaccttcgatacagaataccagaagaccaagaacaacgactgggactacgtggtcacaaccgatatttctgagatgggcgctaattttagagccgaccgggtgatcgatcccagacgctgccttaaacctgttattctgaaggacgggcccgaacgggtgatcctggcgggcccgatgcctgtcacggtggcttccgccgcccagagacgcggacggatcggcagaaaccacaataaggagggggatcagtatatttacatgggacagcccctcaacaatgacgaggatcatgctcactggacagaagccaaaatgctgcttgacaacatcaatacccccgagggcattatccctgcgctgttcgaacccgagcgcgaaaagagcgccgctattgatggggagtatcggctcagaggagaggcccgcaaaacatttgttgaactgatgagacggggcgacctgcctgtgtggctctcctacaaggtcgcttctgaggggttccaatatagcgatcgcagatggtgctttgacggcgaacggaacaatcaggtgcttgaggaaaacatggatgtcgagatctggaccaaagagggagaacgcaagaaactgagaccgcggtggctggacgccagaacgtactccgaccccctcgctctgcgcgagttcaaggaatttgccgcgggccggagatctgtgagcggggatcttatcctggagattggaaagctccctcagcacctgacccagcgcgcccaaaatgctctggacaacctcgttatgcttcataattccgaacagggcgggcgggcctatagacacgctatggaggagctgcccgatacaatcgaaaccctgatgctcctggcccttattgccgtgctgacaggaggcgtgaccctcttctttctgagcggccgggggctgggaaaaacatctatcggcctcctttgtgtcatggcttccagcgttctgctgtggatggcgtctgtggagcctcattggattgccgcttccatcatcctcgagttctttctgatggtgcttctgattcccgagccggaccgccagagaacccctcaggataaccaactcgcctacgtcgtgatcgggctgctgttcatgattctcacggttgccgctaatgagatgggacttctggaaacaaccaagaaagacctgggcatcgggcacgtggccgtcgagaaccaccatcacgcggccatgctcgatgtggacctgcatcccgctagcgcctggaccctttacgctgtcgccacaaccattatcacacctatgatgcggcacacgattgaaaacaccacagcgaatatctctctgaccgccatcgctaaccaggccgctattctcatgggactggataagggctggcccatcagcaaaatggacattggcgtgcctctgctcgcccttgggtgctattcccaggttaatcccctgacactgaccgctgccgtgctcatgctggtcgcgcattacgccatcattggaccgggccttcaagctaaggccacgcgcgaggctcagaagagaaccgccgccgggatcatgaaaaaccctacagtggatggaatcgttgcgattgacctggatcccgtggtctatgacgctaagtttgaaaaacagctcggccagatcatgctgctgattctctgtacctctcaaatccttctgatgcggacaacctgggccctgtgcgagagcattacgctcgctgtggggttccagacaaccctgtgggagggatcccccggcaagttctggaatacaaccatcgccgtgagcatggccaacatctttcgcggctcctaccttgctggggccggactggcgttctctctcatgaaaagcctgggcgggggaagacggggcaccggggcccagggagaaacactgggcgagaagtggaagcgccagctcaatcaactttccaaatctgaatttaacacgtataagagaagcggcattatggaggttgaccggtccgaagctaaagaggggctgaagagaggagagaccacaaaacacgccgtctctcgcggcaccgctaagctgcggtggttcgtggaaagaaatctcgtgaagcctgaggggaaagtcatcgatctgggatgtggccgcgggggatggagctactattgcgccggccttaagaaagttacagaagtgaagggctacaccaaagggggaccgggccacgaggaacccattcctatggcgacgtacgggtggaacctggtgaagctccattccggaaaagacgtctttttcgtgccccctgagaagtgtgatacactgctgtgcgacatcggcgagagctctcccaatcctaccattgaagaggggcggaccctcagagttcttaagatggtggaaccgtggctgcgcggaaaccagttttgtatcaaaattctgaatccctatatgccttccgtcgtggagacactcgagcagatgcagcggaagcacggcggcatgctggttagaaacccccttagccgcaattctacccatgaaatgtactgggtgtcctgcgggacaggaaacatcgtcagcgccgtgaatatgacgtctcggatgctgctcaacagattcaccatggctcaccgcaaacctacatatgagcgggatgtggacctgggcgccgggaccagacacgtcgctgttgaacccgaggtggccaacctggatatcattggacaacgcatcgaaaatattaagcatgagcacaaatccacatggcattacgacgaggataacccgtataagacctgggcttaccacggcagctatgaagtgaagccttccgggagcgcctctagcatggtcaatggagtggttaaactcctgacgaagccctgggacgtgatccccatggtcacccagattgcgatgacagataccacaccttttggccagcaaagagtgttcaaagagaaggttgacacccggacacccaaagccaagcgcggcaccgctcagatcatggaagtgacggccaagtggctttgggggtttctgtccagaaacaaaaagcctcggatctgtacaagagaggagttcacccggaaagtccgctctaatgctgccattggagccgtgtttgttgacgagaaccagtggaatagcgcgaaggaggctgtggaagatgagagattctgggacctcgtccatcgggaacgcgagctgcacaaacagggcaagtgcgcgacctgcgtgtacaacatgatggggaagagagagaagaaacttggagagttcggcaaagccaaggggtcccgggctatctggtacatgtggctgggcgcccgctttctcgagttcgaagctctgggatttatgaatgaggatcactggttctctagagaaaacagcctgtccggcgtcgagggggagggactccataaactgggctatattcttcgggacatctctaagattagcgggggaaatatgtacgccgatgacacagcgggctgggatacgcgcatcaccgaagacgatctgcaaaacgaggccaaaatcacagacattatggaaccggagcacgctctcctggccaagtccatctttaaacttacctatcagaataaagtggttagagtgcagcggcccgctaagaacgggacagtcatggatgtgattagccgcagagaccagcggggctctggacaagtgggcacctacgggctgaatacattcaccaacatggaagcccagctcatccgccagatggagtccgagggaatttttagcccttctgaactggagacgcccaacctggcggaaagagccctcgattggctggagaaacatggcgttgaacggcttaagagaatggctatctccggggacgactgtgtggtcaaacctatcgatgaccgcttcgccaccgctctgacagccctcaatgatatgggaaaggtgcggaaggacattccccagtgggagccgagcaaaggctggaacgattggcaacaggttcctttttgctcccaccacttccatcagctgatcatgaaggacgggagagagattgtggtcccctgtcgcaatcaggatgaacttgtgggccgggctagagtctctcaaggagccggctggagcctgcgcgagaccgcgtgcctcgggaaatcctatgcccagatgtggcagctgatgtactttcaccggagagacctgcgcctcgctgccaacgccatctgtagcgctggacctgtggattgggttcccacatctcggaccacgtggtccattcatgcccaccatcaatggatgacaaccgaagacatgctgagcgtgtggaatagagtctggatcgaggaaaacccttggatggaggataagacacacatttctagctgggaggacgtgccctatcttggcaaacgcgaagaccagtggtgcgggtccctgatcggactcaccgcgcgggctacgtgggccaccaatatccaggttgccattaaccaggtgagacggctgatcggcaatgagaactaccttgattacatgacatctatgaagagattcaagaatgaaagcgacccggagggggctctgtggtga

SEQ ID NO: 18572 - RNA, 9879 nt, synthetic construct
  misc_feature 1..9879: note = derived and/or modified CDS sequence (opt5) from DENV-1__FJ639694__SS-prME
  source 1..9879: mol_type = other RNA
agcgtgaccatgctgctcatgctgatgcccaccgcccttgctttccacctgacgaccagaggaggggagcctcatatgatcgtgtccaagcaggaacggggaaagtctctcctgtttaagacaagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccaccagcttctctatgacctgtattgccgtgggcctggttacactgtaccttggggtgatggtccaggctgattccggatgcgtgatcaactggaaaggccgcgaactcaagtgtgggagcggaatttttgttaccaatgaggtgcacacatggaccgaacaatataagttccaggccgactcccctaaacggctgtctgcggccatcggcaaggcttgggaggagggggtctgcggcatcagaagcgccacgcgcctggaaaacattatgtggaaacagatctccaacgagctcaatcatattctgcttgaaaacgacatgaagtttacagtggttgtgggagatgtcgctggcatcctggcccaggggaaaaagatgattcggccgcaacccatggagtacaaatattcttggagaagctggggaaaggccaagatcatcggcgctgacgtgcagaataccaccttcattatcgatgggcctaacacacccgaatgtcctgacgatcagcgcgcgtggaatatttgggaggtggaggactacggatttggcatcttcaccacgaacatttggctcaaactgcgggattcctatacacaggtctgcgaccacagactgatgagcgccgctatcaaggattctaaagccgttcacgccgacatgggctactggatcgaatccgagaagaatgaaacctggaaacttgctcgcgccagcttcattgaggtgaagacatgtatctggcccaagtctcataccctctggtccaacggggtgctggaaagcgagatgattatcccgaaaatttatggaggccctatctctcaacacaattaccggcccgggtactttacacagaccgcgggaccttggcatctgggcaagctcgagctggatttcgacctttgcgaagggacgaccgtcgtggttgatgagcactgcggaaacagaggccccagcctgcggacaaccacagtgaccggcaaaatcattcacgaatggtgttgccgctcctgtacgctccctcccctgagatttagaggggaagacggatgctggtatggcatggagatcagaccggtcaaggaaaaagaggaaaatctggtcaaaagcatggtttctgctgggtccggagaggtggacagcttctcccttggcctcctgtgtatttctatcatgattgaagaggtcatgcgcagccggtggtccagaaagatgctgatgacagggaccctcgccgtgtttctgcttctgatcatgggacagctcacatggaacgatctgattcgcctgtgcatcatggttggcgccaatgcttctgacagaatgggcatggggaccacctaccttgccctgatggcgacattcaaaatgcggcctatgtttgctgtgggactcctgttccgcagactcacgagccgggaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagcgggacgataccctgacaattcttctgaaagccaccctcctggctgtttctggagtgtatcctctcagcatccccgccacactgttcgtctggtacttctggcaaaagaaaaagcagcgctccggcgtgctttgggacaccccttctcccccggaagtcgagagagccgtgctggatgacggcatttatcggatcatgcagcgcgggctgctcggaagaagccaggttggcgtgggggtctttcaagaaaacgtgttccatacgatgtggcacgttacccggggagctgtgctgatgtaccagggcaagagacttgagccttcctgggccagcgtcaaaaaggacctgatttcttacgggggaggctggcgcctccagggctcctggaatacaggggaggaagtccaggtgatcgcggttgagcccggcaagaaccctaagaatgtccaaaccgctcccggcacatttaaaaccccggaaggggaggtgggagccattgccctggatttcaagcctggcacaagcgggtctcccatcgtgaaccgggaaggaaagatcgtcggcctctatggcaatggggtggttacgacctccggaacatacgtgagcgctattgcccaggcgaaggcttcccaggagggccctctgcccgagatcgaagacgaggtctttagaaagcgcaaccttaccattatggatctgcaccccgggtctggaaaaacccggagatatctgcctgccatcgtgcgcgaagccattaagcggaaactcagaacactgatccttgctccgacgcgcgttgtggccagcgagatggctgaagccctgaagggcatgcccatccggtaccaaaccacagcggtcaagtccgagcataccgggaaagagattgtggacctcatgtgccacgccacattcaccatgagactgctgagccctgttcgggtgcccaattataacatgatcattatggatgaagctcattttacggacccttcttccatcgccgctcgcggctacattagcacaagagtcggaatgggcgaggccgccgctatcttcatgaccgcgacaccccctgggtctgtggaagcctttccgcagagcaatgctgtgatccaggatgaggaacgggacattcccgagcgctcctggaactctggatatgagtggatcacagatttccctggcaagaccgtctggtttgttcccagcattaaatccgggaatgacatcgccaactgtctcagaaagaatggaaaacgggtgattcagctttctagaaagacattcgataccgaataccaaaagacgaaaaacaacgactgggactacgtggtcacaaccgatatcagcgagatgggcgccaatttccgcgctgaccgggtgattgatcctagacgctgcctgaagcccgttatcctgaaagacgggccggaacgggtgatcctcgccggccctatgcccgtcacagtggcgtccgctgcccagagacgcggacggattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgcgaaaagagcgcggccatcgatggggagtatagactgcggggagaggctcgcaagaccttcgttgaactgatgagacggggcgacctcccggtgtggctttcttacaaagtcgcctccgaggggtttcaatatagcgatcgcagatggtgcttcgacggcgaacggaacaatcaggtgctggaggaaaacatggatgtcgagatctggacaaaggagggagaaagaaagaaactgcgcccccggtggctcgacgctagaacctactccgaccctctggcccttcgcgagtttaaagagttcgctgccggccggagatctgtgagcggggatctgattctcgagatcggaaaactgccccagcacctgacacagcgggcgcaaaatgccctcgacaaccttgttatgctgcataattccgaacagggcgggcgcgcttatagacacgccatggaggagctgcctgataccattgaaacactcatgctgcttgctctgatcgccgtgctcaccggaggcgtgacgctgtttttcctgtctggccgggggctcggaaaaacaagcattggccttctgtgtgtcatggcctccagcgttctgctctggatggcttctgtggagccccattggatcgcggcctccatcattctggaatttttccttatggtgctgctcatcccggagcctgaccgccagagaacaccccaggataaccaactggcttacgtcgtgattgggctgctctttatgatccttaccgttgccgccaatgagatgggactgctggaaacaaccaagaaggacctcggcattgggcacgtggctgtcggaaaccaccatcacgccgcgatgctggatgtggaccttcatcctgccagcgcttggacactgtacgccgtcgctacgaccatcattacacccatgatgcggcacaccatcgagaacacaaccgccaatatctctctcacggcgattgccaaccaggctgccatcctgatgggcctggataaaggctggcctatttccaagatggacatcggggtgcccctccttgctctgggatgctatagccaggttaatccgctgaccctcacagccgctgtgctgatgcttgtcgcccattacgcgattatcggccctgggctgcaagccaaagctacccgcgaagcccagaagagaacagctgccggaatcatgaaaaaccccaccgtggatggcattgttgccatcgacctcgatcccgtggtctatgacgcgaagttcgagaagcagctggggcagattatgctgctcatcctttgtacgtctcaaattctgctgatgcggacaacctgggctctctgcgaaagcatcacactggccaccggacctcttaccacactgtgggagggctccccgggcaaattttggaatacgaccatcgctgtgtctatggccaacattttccgcgggagctacctcgccggagctggcctggccttctccctgatgaaaagcctcgggggaggcagacgggggacaggagcgcagggcgagacccttggcgaaaaatggaagagacagctgaatcagctgtccaaatctgagtttaacacatataagcgcagcgggatcatggaagtggaccggtccgaggccaaggaaggactcaaaagaggcgagattaccaagcacgctgtttctcgcgggacggccaaactgcggtggttcgtcgagagaaatcttgtgaagcccgaaggaaaagtgatcgatctgggctgtgggcgcggaggctggagctactattgcgctggcctcaagaaggtcacagaggttaaagggtacaccaagggaggccctgggcacgaggagcccattcctatggccacctacggatggaacctggtgaaactgcattccggcaaggacgtgtttttcgtgccccctgaaaaatgtgatacactcctttgcgacatcggggagtctagcccgaatcccaccattgaggaaggacggacactgagagtgctgaagatggttgagccttggctccgcggcaaccaattttgtatcaaaatcctgaatccctatatgccttccgtggtcgaaacgcttgagcagatgcagcggaagcacggcgggatgctggtgagaaaccccctcagccgcaattctacccatgagatgtactgggtttcctgcggaacaggcaacattgtgagcgcggtcaatatgacctctcggatgctgctgaacagattcacaatggcccaccgcaagccgacctatgaaagagatgtggacctcggggctggaacgcggcacgtggccgtcgagcctgaagttgctaacctggatatcattggccagcgcatcgagaatattaaacatgaacacaagtccacctggcattacgacgaggataacccctataaaacatgggcctaccacgggagctatgaggtgaagccctctggatccgctagctccatggtgaatggcgtcgtgaaacttctgaccaagccttgggacgttatccccatggtgacacaaatcgccatgaccgatacaaccccttttggccagcagagagtcttcaaggaaaaagtggacacgcggacaccgaaggcgaaaagagggaccgcccaaattatggaggttaccgctaagtggctctggggatttctgagccggaacaaaaagccccgcatctgtacaagagaagagttcacgcggaaggtgcgctctaatgccgctattggcgccgtctttgtggacgaaaaccagtggaatagcgccaaagaggcggttgaggatgaaagattctgggaccttgtgcatcgggagcgcgaactgcacaagcaggggaaatgcgctacctgcgtctacaacatgatgggaaagagagagaaaaagctcggcgaatttgggaaggccaaaggctcccgggccatctggtacatgtggctgggagctcgcttcctggagttcgaggccctcggctttatgaatgaagatcactggttctctagagagaacagcctgtccggggtggaaggagagggccttcataagctggggtatattctccgggacatctctaaaatccctggaggcaatatgtacgctgatgacacagccgggtgggatacccgcattacagaggacgatctgcagaacgaagcgagaatcaccgacattatggagcccgaacacgcccttctggctaagagcatctttaaactcacatatcaaaataaggtcgtgcgggttcagcgccctgccaaaaacggcaccgtgatggatgtcatttccagacgggaccagagaggatctggccaggtggggacgtacggactgaataccttcacaaacatggaggctcaactgatccgccagatggaaagcgagggcatcttttcccccagcgagctcgaaaccccgaacctggccgagcgggtgcttgattggctggaaaagtatggggttgagagactcaagcgcatggcgatttctggagacgactgtgtggtcaaacctatcgatgaccggttcgccacagctctgaccgcccttaatgatatgggcaaggtgagaaaagacattccccagtgggaaccttccaaggggtggaacgattggcagcaagttcccttttgcagccatcacttccaccagctgatcatgaaagacggccgcgagattgtggtcccttgtcggaatcaggatgagctcgtgggacgggctcgcgtctctcagggcgccgggtggtccctgcgggaaacggcttgcctgggaaagagctacgcccaaatgtggcagctcatgtattttcatagacgcgacctgcggcttgcggccaacgctatctgttccgccgtgcccgttgattggattccgacatctagaaccacatggagcatccacgcccatcaccagtggatgaccacggaggacatgctgtccgtgtggaatcgggtctggatcgaagagaacccttggatggaagataagacccatattagcaattggggcgacgtgccctacctcgggaaaagagaggaccaatggtgcggatctctgatcggccttacagctcgcgccacctgggcgacaaacattcaggttgctatcaatcaggtgcggagactgattgggaacgagaattacctcgattatatgacctccatgaagcgcttcaaaaacgaaagcgaccccgagggcgccctgtggtga

SEQ ID NO: 18573 - RNA, 9879 nt, synthetic construct
  misc_feature 1..9879: note = derived and/or modified CDS sequence (opt5) from DENV-1__FJ639695__SS-prME
  source 1..9879: mol_type = other RNA
agcgtgaccatgctgctgatgctgatgcccaccgcccttgctttccacctgacgaccagaggcggggagcctcatatgatcgtgtccaagcaggaacggggaaagtctctcctgtttaagaccagcgccggcgttaacatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaggaacaagacgctaacttcgtgtgccggcgcacatttgtggatagaggctggggcaatgggtgtggactcttcggcaaagggtctctgatgacctgcgccaagtttaagtgcgtcacaaaacttgagggaaagatcgtgcagtacgaaaacctgaaatattccgttatcgtgacggtccacaccggcgaccagcatcaagtggggaatgagagcacagaacacggaaccacagctaccattacgccccaggcccctaccacagagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggctgggcgtccttctgacctggctcggactcaattctagatccacaagcctgtctatgacctgtattgccgtgggccttgttacactctacctgggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctctctgcggccatcggcaaggcttgggaggagggggtctgcggcattagaagcgccacgcgcctggaaaacatcatgtggaaacagatctccaacgagcttaatcatattctgctcgaaaacgacatgaagttcacagtggttgtgggagatgtcgctggcatcctggcccaggggaaaaagatgattcggccgcaacccatggagtacaaatattcttggaaaagctggggaaaggccaagatcattggcgctgacgtgcagaataccacctttatcatcgatgggcctaacacacccgaatgtcctgacgatcagagagcgtggaatatttgggaggtggaggactacggattcggcatctttaccacgaacatttggctgaaacttcgcgattcctatacacaggtctgcgaccaccggctcatgagcgccgctatcaaagattctaaggccgttcacgccgacatgggctactggattgaatccgagaaaaatgaaacctggaagctggctagagccagcttcatcgaggtgaagacatgtatctggcccaaatctcataccctgtggtccaacggggtgctcgaaagcgagatgattatcccgaagatttatggaggccctatctctcaacacaattaccgccccgggtacttcacacagaccgcgggaccttggcatctgggcaaacttgagctggattttgacctctgcgaagggacgaccgtcgtggttgatgagcactgcggaaaccggggccccagcctgagaacaaccacagtgaccggcaagattatccacgaatggtgttgccggtcctgtacgctgcctccccttcgcttcagaggggaggacggatgctggtatggcatggagatccggccggtcaaagaaaaggaggaaaatctcgtcaagagcatggtttctgctgggtccggagaggtggacagcttttccctgggcctgctctgtatttctatcatgattgaagaggtcatgagaagccgctggtcccggaaaatgctgatgacagggacccttgccgtgttcctgctcctgatcatgggacagctgacatggaacgatcttattagactgtgcatcatggttggcgccaatgcttctgaccgcatgggcatggggaccacctacctcgccctgatggcgacatttaagatgagacctatgttcgctgtgggactcctgtttcggcgccttacgagcagagaggtcctgctcctgaccattggcctgtcccttgtggcctctgtggaactgcccaacagcctcgaggaactgggggatggactcgccatgggcatcatgatcctgaaacttctgacagacttccaatcccatcagctctgggctaccctgctgagccttacatttattaagaccacgttctctctgcactatgcctggaaaacaatggctatggtcctctccatcgttagcctgtttcccctctgtctgtctaccacctcccagaagacaacctggcttcctgtgctgctggggagcctcggatgcaagccgctgacaatgttccttattgccgagaataaaatctggggccggcgctcttggcccctgaacgaaggcattatggcggtggggatcgtctccatcctcctgagctccctcctgaagaacgatgtgcctcttgccggacccctgattgctggcgggatgctgatcgcctgttacgttattagcggatctagcgctgacctctccctggagaaagccgccgaggtgtcttgggaagaggaagctgagcatagcggcgcgtcccacaatatccttgtcgaagtgcaggatgacgggacgatgaagattaaagatgaggagagagacgataccctgacaatcctcctgaaggccaccctcctggctgtttctggagtgtatcctcttagcatccccgccacactgtttgtctggtacttctggcagaagaagaagcagcggtccggcgtgctgtgggacaccccttctcccccggaagtcgagcgcgccgtgctcgatgacggcatttatagaatcatgcagcgggggctgcttggacgcagccaggttggcgtgggggtcttccaagaaaacgtgtttcatacgatgtggcacgttaccagaggagctgtgctgatgtaccagggcaaacggctcgagccttcctgggccagcgtcaagaaagacctgatttcttacgggggaggctggagactccagggctcctggaatacaggggaggaagtgcaagtgatcgcggttgagcccggaaagaaccctaaaaatgtccaaaccgctcccggcacattcaagaccccggaaggggaggtgggagccattgccctggattttaagcctggcacaagcgggtctcccatcgtgaaccgcgaaggaaaaattgtcggcctttatggcaatggggtggttacgacctccggaacatacgtgagcgctatcgcccaggcgaaggcttcccaggagggccctctgcccgagatcgaagacgaggtcttccggaaaagaaacctgaccattatggatctccaccccgggtctggaaagacccgccggtatctgcctgccatcgtgagagaagccattaaacgcaaacttcggacactgatcctcgctccgacgagagttgtggccagcgagatggctgaagccctgaagggcatgcccattcgctaccaaaccacagcggtcaaatccgagcataccgggaaggagatcgtggacctgatgtgccacgccacatttaccatgcggctccttagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgattcaggatgaggaaagagacatccccgagcggtcctggaactctggatatgagtggatcacagattttcctggcaaaaccgtctggttcgttcccagcattaagtccgggaatgacatcgccaactgtctgcgcaaaaatggaaagagagtgattcagctgtctcggaagacatttgataccgaataccagaagacgaagaacaacgactgggactacgtggtcacaaccgatatcagcgagatgggcgccaatttcagagctgaccgcgtgattgatcctcggagatgcctcaaacccgttatcctgaaggacgggccggaacgcgtgattcttgccggccctatgcccgtcacagtggcgtccgctgcccagcggagaggacgcatcggccggagccacaacaaagagggggatcagtatatctacatgggacagcccctgaataacgacgaggatcatgcccactggaccgaagctaagatgctcctggacaatattaacacgcctgagggcatcattcccgccctgttcgaacctgagagagaaaagtctgcggccatcgatggggagtatcgcctcagaggagaggctcggaaaacctttgttgaacttatgcgcagaggcgacctgccggtgtggctgtcctacaaggtcgccagcgaggggttccaatattccgatcggcgctggtgctttgacggcgaaagaaataaccaggtgctcgaggaaaatatggatgtcgagatttggacaaaagagggagaacggaagaaactgagaccccgctggcttgacgctcggacctactctgaccctctggccctcagagagttcaaggaatttgctgccggccgccggagcgtgtccggggatctgatcctggagatcggaaaactcccccagcaccttacacagagagcgcaaaacgccctggacaatctggttatgctccataactctgaacagggcgggcgggcttatcgccacgccatggaggagctgcctgataccattgaaacacttatgctgctcgctctgatcgccgtgctgaccggaggcgtgacgctgttctttcttagcggcagagggctgggaaagacatccattggcctgctctgtgtcatggccagctctgttctgctttggatggcttccgtggagccccattggatcgcggccagcattatcctggagttctttctcatggtgctgctgatcccggagcctgaccggcagcgcacaccccaggataatcaactcgcttacgtcgtgattgggcttctgttcatgatcctgaccgttgccgccaacgagatgggactcctggaaacaaccaagaaagaccttggcattgggcacgtggctgtcggaaatcaccatcacgccgcgatgctggatgtggacctccatcctgcctctgcttggacactgtacgccgtcgctacgaccatcattacacccatgatgagacacaccatcgagaacacaaccgccaacatttccctgacggcgatcgccaatcaggctgccatcctcatgggccttgataagggctggcctattagcaaaatggacatcggggtgcccctgctggctctcggatgctattctcaggttaacccgctgacccttacagccgctgtgctgatgctcgtcgcccattacgcgattatcggccctgggctgcaagccaaggctacccgggaagcccagaaacgcacagctgccggaattatgaagaatcccaccgtggatggcatcgttgccatcgacctggatcccgtggtctatgacgcgaagtttgagaaacagctcgggcagattatgcttctgatcctgtgtacgagccaaattctcctgatgagaacaacctgggctctttgcgaatccatcacactggccaccggacctctcaccacactgtgggagggctctccgggcaagttctggaacacgaccattgctgtgagcatggccaatatctttcgggggtcctacctggccggagctggcctcgccttcagccttatgaaatccctcgggggaggccgcagagggacaggagcgcagggcgagaccctgggcgaaaagtggaaacggcagctcaaccagctgtctaagagcgagttcaatacatataagagatccgggatcatggaagtggaccgctctgaggccaaagaaggacttaagcggggcgagaccacgaaacacgctgttagcagagggacagccaagctgcgctggtttgtcgagcggaacctcgtgaaacccgaaggaaaggtgattgatctgggctgtgggagaggaggctggtcctactattgcgctggcctgaagaaagtcaccgaggttaaggggtacaccaaaggaggccctgggcacgaagaacccatccctatggccacatacggatggaatctcgtgaaacttcattctggcaaagacgtgttctttattccccctgaaaagtgtgataccctgctgtgcgacatcggggagagctccccgaaccccacaattgaggaaggacgcacgctccgggtcctgaaaatggtggagccttggcttagaggcaatcaattctgtatcaagattctgaacccctatatgcctagcgttgtggaaaccctcgagcagatgcagcgcaagcacggcgggatgctggtccggaatcccctgtctagaaactccacacatgagatgtactgggtgagctgcggaaccggcaatatcgtttctgcggtgaacatgacatcccgcatgctcctgaatcggtttaccatggcccacagaaaaccgacgtatgaacgcgatgtcgaccttggggctggaaccagacacgtggccgtggagcctgaagtcgctaacctggatatcattggccagcggatcgagaacattaagcatgaacacaaaagcacatggcattacgacgaggataatccctataagacctgggcctaccacgggtcttatgaggttaaaccctccggaagcgcttccagcatggtgaacggcgtggtcaagctcctgacaaagccttgggacgtgatccccatggttacccaaattgccatgacagataccacgcctttcggccagcagcgcgtgtttaaagaaaaggtcgacacaagaaccccgaaagcgaagcgggggaccgcccaaatcatggaggtgacagctaaatggctttggggattcctgtctagaaataagaagccccggatctgtacgcgcgaagagtttaccagaaaagttcggagcaacgccgctattggcgccgtgttcgtcgacgaaaatcagtggaactccgccaaggaggcggtggaggatgaacgcttttgggacctcgttcatagagagcgggaactgcacaaacaggggaagtgcgctacatgcgtgtacaatatgatgggaaaacgcgagaagaagctgggcgagttcgggaaagccaagggctctagagccatctggtacatgtggctcggagctcggtttctggagttcgaggcccttggcttcatgaacgaagatcactggtttagccgcgaaaattccctgtctggggtcgaaggagagggcctccataaactggggtatattcttagagacatcagcaagattcctggaggcaacatgtacgctgatgacaccgccgggtgggatacacggatcaccgaggacgatctgcagaatgaagcgcgcatcacagacattatggagcccgaacacgccctcctggctaaatccatcttcaagctgacctatcaaaacaaagtggtcagagtgcagcggcctgccaagaatggcacggttatggatgtgatttctcgcagagaccagcggggaagcggccaggtcgggacctacggactcaacacatttaccaatatggaggctcaactgatcagacagatggaatccgagggcattttcagcccctctgagcttgaaacaccgaacctggccgagcgcgtgctcgtgtggctggaaaagtatggggttgagcggcttaaaagaatggcgatctccggagatgactgtgtggtcaagcctatcgacgatcgctttgccaccgctctgacggccctcaacgacatgggcaaagtgcggaaggatattccccagtgggaacctagcaaagggtggaatgactggcagcaagttcccttctgctctcatcactttcaccagctgatcatgaaggatggcagagagattgtggtcccttgtcgcaaccaggacgagctggtgggacgggctagagtctcccagggcgccgggtggagcctccgcgaaacagcttgcctgggaaagtcctacgcccaaatgtggcagcttatgtatttccatcggagagatctgcgcctcgcggccaatgctatctgttctgccgtgcccgttgactggattccgaccagccggacaacctggtccatccacgcccatcaccagtggatgacgaccgaggatatgctgagcgtgtggaacagagtctggattgaagagaatccttggatggaagacaaaacacatatctcttcctggggcgatgtgccctaccttgggaagcgggaggaccaatggtgcggaagcctgatcggcctcaccgctagagccacatgggcgaccaacattcaggttgctatcaatcaggtgcgccggctgattgggaacgagaattacctggactatatgacatctatgaaaagatttaagaacgaaagcgatcccgagggcgccctctggtga

SEQ ID NO: 18574 - RNA, 9879 nt, synthetic construct
  misc_feature 1..9879: note = derived and/or modified CDS sequence (opt5) from DENV-1__FJ639696__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgtggaagccttccctcagagcaatgctgtcatccaggatgaggaacgggacatcccggagcgctcctggaactctggatatgagtggattacagattttcccggcaaaaccgtttggttcgtgcctagcatcaagtccgggaatgacattgccaactgtctgagaaagaatggaaaacgggtgatccagctcagccgcaagaccttcgatacagaataccagaagaccaagaacaacgactgggactacgtcgtgacaaccgatatttctgagatgggcgccaattttagagctgaccgggttatcgatcccagacgctgccttaaacctgtgattctgaaggacgggcccgaacgggtcatcctggccggcccgatgcctgtgacggttgcgtccgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagagcgcggccattgatggggagtatcggctcagaggagaggctcgcaaaacatttgtggaactgatgagacggggcgacctgcctgtctggctctcctacaaggtggcctctgaggggttccaatatagcgatcgcagatggtgctttgacggcgaacggaacaatcaggtccttgaggaaaacatggatgtggagatctggaccaaagagggagaacgcaagaaactgagaccgcggtggctggacgctagaacgtactccgaccccctcgccctgcgcgagttcaaggaatttgctgccggccggagatctgttagcggggatcttatcctggagattggaaagctccctcagcacctgacccagcgcgcgcaaaatgccctggacaacctcgtgatgcttcataattccgaacagggcgggcgggcttatagacacgccatggaggagctgcccgatacaatcgaaaccctgatgctcctggctcttattgccgtgctgacaggaggcgtcaccctcttctttctgagcggccgggggctgggaaaaacatctatcggcctcctttgtgttatggcctccagcgtgctgctgtggatggcttctgtggagcctcattggattgcggcctccatcatcctcgagttctttctgatggtccttctgattcccgagccggaccgccagagaacccctcaggataaccaactcgcttacgtggttatcgggctgctgttcatgattctcacggtggccgccaatgagatgggacttctggaaacaaccaagaaagacctgggcatcgggcacgtcgctgtggagaaccaccatcacgccgcgatgctcgatgtcgacctgcatcccgccagcgcttggaccctttacgccgtggctacaaccattatcacacctatgatgcggcacacgattgaaaacaccacagccaatatctctctgaccgcgatcgccaaccaggctgccattctcatgggactggataagggctggcccatcagcaaaatggacattggcgttcctctgctcgctcttgggtgctattcccaggtgaatcccctgacactgaccgccgctgtcctcatgctggtggcccattacgcgatcattggaccgggccttcaagccaaggctacgcgcgaggcccagaagagaaccgctgccgggatcatgaaaaaccctacagttgatggaatcgtggccattgacctggatcccgtcgtgtatgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgtgagcatggccaacatcttccgcggctcctacctggccggggctggactcgccttttctctgatgaaaagcctgggcgggggaagacggggcacaggggcgcagggagaaacgctcggcgagaagtggaagcgccagcttaatcagctgtccaaatctgagttcaacacctataagagaagcggcattatggaggttgaccggtccgaagccaaagaggggctgaagagaggagagacaaccaaacacgctgtctctcgcggcacagccaagctccggtggtttgtggaaagaaatctggtgaagccggaggggaaagtcatcgatcttggatgtggccgcgggggatggagctactattgcgctggcctgaagaaagttaccgaagtgaagggctacacgaaagggggacccggccacgaggaacctattcccatggccacatacgggtggaacctcgtgaagctgcattccggaaaagacgtcttctttgtgcctcccgagaagtgtgataccctgctctgcgacatcggcgagagctctcctaatccgaccattgaagaggggcggacacttagagttctgaagatggtggaaccctggctgcgcggaaaccaattctgtatcaaaattctcaatccttatatgccctccgtcgtggagaccctggagcagatgcagcggaagcacggcggcatgcttgttagaaaccctctgagccgcaattctacacatgaaatgtactgggtgtcctgcgggacgggaaacatcgtcagcgcggtgaatatgacctctcggatgctcctgaacagatttacaatggcccaccgcaaacccacctatgagcgggatgtggacctgggcgctgggacaagacacgtcgccgttgaaccggaggtggctaacctcgatatcattggacagcgcatcgaaaatattaagcatgagcacaaatccacctggcattacgacgaggataacccttataagacgtgggcctaccacggcagctatgaagtgaagccctccgggagcgcttctagcatggtcaatggagtggttaaactgcttaccaagccctgggacgtgatccctatggtcacacaaattgccatgaccgatacaacccccttcggccagcagagagtgtttaaagagaaggttgacacacggacccctaaagcgaagcgcggcacggcccaaatcatggaagtgacagctaagtggctgtgggggttcctctccagaaacaaaaagccgcggatctgtaccagagaggaatttacccggaaagtccgctctaatgccgctattggagccgtgttcgttgacgagaaccagtggaatagcgccaaggaggcggtggaagatgagagattttgggacctggtccatcgggaacgcgagcttcacaaacagggcaagtgcgctacatgcgtgtacaacatgatggggaagagagagaagaagctgggagagttcggcaaagccaaggggtcccgggccatctggtacatgtggctcggcgctcgcttcctggagtttgaagccctgggattcatgaatgaggatcactggttttctagagaaaacagcctctccggcgtcgagggggagggactgcataaacttggctatattctgcgggacatctctaagattagcgggggaaatatgtacgctgatgacacggccggctgggatacccgcatcacagaagacgatctccagaacgaggcgaaaatcaccgacattatggaacccgagcacgccctgcttgctaagtccatcttcaagctgacatatcaaaataaagtggttagagtgcagcggcctgccaagaacgggaccgtcatggatgtgattagccgcagagaccagcggggctctggacaggtgggcacatacgggctcaatacctttacgaacatggaagctcaactgatccgccagatggagtccgagggaattttcagcccctctgaactggagacccctaacctcgccgaaagagcgctggattggcttgagaaacatggcgttgaacggctgaagagaatggccatctccggggacgactgtgtggtcaaacccatcgatgaccgctttgctacagccctcaccgctctgaatgatatgggaaaggtgcggaaggacattccgcagtgggagcctagcaaaggctggaacgattggcagcaagttcccttctgctcccaccactttcatcagcttatcatgaaggacgggagagagattgtggtcccttgtcgcaatcaggatgaactggtgggccgggccagagtctctcagggagctggctggagcctccgcgagacagcctgcctggggaaatcctatgcgcaaatgtggcagctgatgtacttccaccggagagacctccgcctggccgctaacgccatctgtagcgccgtgcccgttgattgggtgcctacctctcggacgacatggtccattcatgctcaccatcagtggatgaccacagaagacatgcttagcgtctggaatagagtgtggatcgaggaaaacccctggatggaggataagacccacatttctagctgggaggacgttccgtatctgggaaaacgcgaagaccaatggtgcggctccctcatcgggctgacggcccgggcgacctgggctacaaatatccaggtggccattaaccaggtcagacggcttatcggaaatgagaactacctggattacatgacctctatgaagagatttaagaatgaaagcgacctcgagggcgccctgtggtga

SEQ ID NO: 18575 - RNA, 9879 nt, synthetic construct
  misc_feature 1..9879: note = derived and/or modified CDS sequence (opt5) from DENV-1__HM181937__SS-prME
  source 1..9879: mol_type = other RNA
agcgtgaccatgctgctcatgctgatgcccaccgcccttgctttccacctgacgaccagaggcggggagcctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggaaaatgctcatgacagggaccctggccgtgttccttctgctcatcatgggacagctgacatggaacgatctgattagactttgcatcatggttggcgccaatgcttctgaccgcatgggcatggggaccacctacctggccctcatggcgacatttaagatgagacctatgttcgctgtgggactgctctttcggcgcctgacgagcagagaggtccttctgctcaccatcggcctgtccctggtggcctctgtggaacttcccaacagcctggaggaactcggggatggactggccatgggcattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctggggagcctgggatgcaagccgctcacaatgttcctgattgccgagaataaaatctggggccggcgctcttggccccttaacgaaggcatcatggcggtggggattgtctccatcctgctcagctccctgctcaagaacgatgtgcctctggccggaccccttattgctggcgggatgctgatcgcctgttacgttattagcggatctagcgctgacctgtccctcgagaaagccgccgaggtgtcttgggaagaggaagctgagcatagcggcgcgtcccacaatatcctggtcgaagtgcaggatgacgggacgatgaagatcaaagatgaggagagagacgatacccttacaattctgctcaaggccaccctgctcgctgtttctggagtgtatcctctgagcatccccgccacactttttgtctggtacttctggcagaagaagaagcagcggtccggcgtgctgtgggacaccccttctcccccggaagtcgagcgcgccgtgctggatgacggcatttatagaatcatgcagcgggggctcctgggacgcagccaggttggcgtgggggtcttccaagaaaacgtgtttcatacgatgtggcacgttaccagaggagctgtgcttatgtaccagggcaaacggctggagccttcctgggccagcgtcaagaaagacctcatttcttacgggggaggctggagactgcagggctcctggaatacaggggaggaagtgcaagtgatcgcggttgagcccggaaagaaccctaaaaatgtccaaaccgctcccggcacattcaagaccccggaaggggaggtgggagccattgccctcgattttaagcctggcacaagcgggtctcccatcgtgaaccgcgaaggaaaaatcgtcggcctgtatggcaatggggtggttacgacctccggaacatacgtgagcgctattgcccaggcgaaggcttcccaggagggccctcttcccgagatcgaagacgaggtcttccggaaaagaaacctgaccattatggatctgcaccccgggtctggaaagacccgccggtatctccctgccatcgtgagagaagccattaaacgcaagctgcggacacttatcctggctccgacgagagttgtggccagcgagatggctgaagccctcaagggcatgcccatccgctaccaaaccacagcggtcaaatccgagcataccgggaaggagattgtggacctgatgtgccacgccacatttaccatgcggctgctcagccctgttagagtgcccaattataacatgatcattatggatgaagctcatttcacggacccttcttccatcgccgctcggggctacattagcacacgcgtcggaatgggcgaggccgccgctatctttatgaccgcgacaccccctgggtctgtggaagccttcccgcagagcaatgctgtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacatttgataccgaataccagaaaacgaagaacaacgactgggactacgtggtcacaaccgatatcagcgagatgggcgccaatttcagagctgaccgcgtgattgatcctcggagatgcctgaaacccgttatcctcaaggacgggccggaacgcgtgatcctggccggccctatgcccgtcacagtggcgtccgctgcccagcggagaggacgcattggccggaaccacaataaagagggggatcagtatatctacatgggacagccccttaacaatgacgaggatcatgcccactggaccgaagctaagatgctgctcgacaacattaatacgcctgagggcatcattcccgccctgttcgaacctgagagagaaaagagcgcggccatcgatggggagtatcgcctgagaggagaggctcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagcgcaaaatgcccttgacaacctggttatgctgcataattccgaacagggcgggcgggcttatcgccacgccatggaggagctccctgataccattgaaacactgatgcttctggctctcatcgccgtgctgaccggaggcgtgacgctgttctttctctctggcagagggcttggaaagacaagcattggcctgctgtgtgtcatggcctccagcgttctcctgtggatggcttctgtggagccccattggatcgcggcctccatcattcttgagttctttctgatggtgctcctgatcccggagcctgaccggcagcgcacaccccaggataaccaactggcttacgtcgtgattgggctccttttcatgatcctgaccgttgccgccaatgagatgggactgctcgaaacaaccaagaaagacctgggcattgggcacgtggctgtcggaaaccaccatcacgccgcgatgcttgatgtggacctgcatcctgccagcgcttggacactctacgccgtcgctacgaccatcattacacccatgatgagacacaccatcgagaacacaaccgccaatatctctctgacggcgattgccaaccaggctgccatcctgatgggcctcgataagggctggcctatttccaaaatggacatcggggtgccccttctggctctgggatgctatagccaggttaatccgctcaccctgacagccgctgtgcttatgctggtcgcccattacgcgattatcggccctgggctccaagccaaggctacccgggaagcccagaaacgcacagctgccggaatcatgaagaaccccaccgtggatggcattgttgccatcgacctggatcccgtggtctatgacgcgaagtttgagaaacagctggggcagattatgctccttatcctgtgtacgtctcaaattctgctcatgagaacaacctgggctctgtgcgaaagcatcacacttgccaccggacctctgaccacactctgggagggctccccgggcaagttctggaatacgaccatcgctgtgtctatggccaacatttttcgggggagctacctggccggagctggcctggccttctccctcatgaaaagccttgggggaggccgcagagggacaggagcgcagggcgagaccctgggcgaaaagtggaaacggcagctgaatcagctctccaagtctgagttcaacacatataagagaagcgggatcatggaagtggaccgctccgaggccaaagaaggactgaagcggggcgagaccacgaaacacgctgtttctagagggacagccaaacttcgctggtttgtcgagcggaatctggtgaaacccgaaggaaaggtgattgatctcggctgtgggagaggaggctggagctactattgcgctggcctgaagaaagtcaccgaggttaaggggtacaccaaaggaggccctgggcacgaagaacccatccctatggccacatacggatggaacctggtgaagctccattccggcaaagacgtgttctttattccccctgaaaagtgtgatacccttctgtgcgacatcggggagtctagcccgaatcccacaattgaggaaggacgcacgctgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgcggtgaatatgacatctcgcatgctgctcaaccggtttaccatggcccacagaaaaccgacgtatgaacgcgatgtcgacctgggggctggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagcgcgtgtttaaagaaaaggtcgacacaagaaccccgaaagcgaagcgggggaccgcccaaattatggaggtgacagctaaatggctgtggggattccttagcagaaacaagaagccccggatctgtacgcgcgaagagtttaccagaaaagttcggtctaatgccgctattggcgccgtgttcgtcgacgaaaaccagtggaatagcgccaaggaggcggtggaggatgaacgcttttgggacctggttcataaagagagagaactccacaagcaggggaaatgcgctacatgcgtgtacaacatgatgggaaagcgggagaagaaactgggcgagttcgggaaggccaaaggctcccgcgccatctggtacatgtggctgggagctagatttctcgagttcgaggccctgggcttcatgaatgaagatcactggttttctcgggagaacagcctttccggggtcgaaggagagggcctgcataagctcgggtatattctgcgcgacatctctaaaatccctggaggcaatatgtacgctgatgacaccgccgggtgggatacaagaattaccgaggacgatcttcagaacgaagcgcggatcacagacattatggagcccgaacacgccctgctcgctaagagcatcttcaaactgacctatcaaaataaggtggtccgcgtgcagagacctgccaagaacggcacggttatggatgtgatttcccggcgcgaccagagaggatctggccaggtcgggacctacggactgaatacatttaccaacatcgaggctcaactcatccggcagatggaaagcgagggcattttctcccccagcgagctggaaacaccgaaccttgccgagagagtgctggattggctcgaaaaatatggggtggagcgcctgaagcggatggcgatctctggagacgactgtgttgtgaaacctattgatgacagatttgccaccgctcttacggccctgaatgatatgggcaaggtccgcaaagacatcccccagtgggaaccttccaaggggtggaacgattggcagcaagtgcccttctgcagccatcactttcaccagctcattatgaaggacggccgggagatcgttgtgccttgtagaaatcaggatgagctggtcggacgcgctcgggtgtctcagggcgccgggtggtccctgagagaaacagcttgcctcggaaaaagctacgcccaaatgtggcagctgatgtatttccatcgccgggaccttagactggcggccaacgctatttgttccgccgtccccgtggattggatcccgacctctcgcacaacctggagcatccacgcccatcaccagtggatgacgaccgaggacatgctctccgtttggaatcgggtgtggattgaagagaacccttggatggaagataagacacatatcagctcttggggcgacgtcccctacctggggaaaagagaggaccaatggtgcggatcccttattggcctgaccgctcgggccacatgggcgaccaatatccaggtggctattaaccaggttagacgcctcatcgggaatgagaactacctggattatatgacaagcatgaagcggtttaaaaatgaatctgaccccgagggcgccctgtggtga

SEQ ID NO: 18576 - RNA, 9879 nt, synthetic construct
  misc_feature 1..9879: note = derived and/or modified CDS sequence (opt5) from DENV-1__HM181939__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgtggaagccttccctcagagcaatgctgtcatccaggatgaggaacgggacatcccggagcgctcctggaactctggatatgagtggattacagattttcccggcaaaaccgtttggttcgtgcctagcatcaagtccgggaatgacattgccaactgtctgagaaagaatggaaaacgggtgatccagctcagccgcaagaccttcgatacagaataccagaagaccaagaacaacgactgggactacgtcgtgacaaccgatatttctgagatgggcgccaattttagagctgaccgggttatcgatcccagacgctgccttaaacctgtgattctgaaggacgggcccgaacgggtcatcctggccggcccgatgcctgtgacggttgcgtccgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagagcgcggccattgatggggagtatcggctcagaggagaggctcgcaaaacatttgtggaactgatgagacggggcgacctgcctgtctggctctcctacaaggtggcctctgaggggttccaatatagcgatcgcagatggtgctttgacggcgaacggaacaatcaggtccttgaggaaaacatggatgtggagatctggaccaaagagggagaacgcaagaaactgagaccgcggtggctggacgctagaacgtactccgaccccctcgccctgcgcgagttcaaggaatttgctgccggccggagatctgttagcggggatcttatcctggagattggaaagctccctcagcacctgacccagcgcgcgcaaaatgccctggacaacctcgtgatgcttcataattccgaacagggcgggcgggcttatagacacgccatggaggagctgcccgatacaatcgaaaccctgatgctcctggctcttattgccgtgctgacaggaggcgtcaccctcttctttctgagcggccgggggctgggaaaaacatctatcggcctcctttgtgttatggcctccagcgtgctgctgtggatggcttctgtggagcctcattggattgcggcctccatcatcctcgagttctttctgatggtccttctgattcccgagccggaccgccagagaacccctcaggataaccaactcgcttacgtggttatcgggctgctgttcatgattctcacggtggccgccaatgagatgggacttctggaaacaaccaagaaagacctgggcatcgggcacgtcgctgtggagaaccaccatcacgccgcgatgctcgatgtcgacctgcatcccgccagcgcttggaccctttacgccgtggctacaaccattatcacacctatgatgcggcacacgattgaaaacaccacagccaatatctctctgaccgcgatcgccaaccaggctgccattctcatgggactggataagggctggcccatcagcaaaatggacattggcgttcctctgctcgctcttgggtgctattcccaggtgaatcccctgacactgaccgccgctgtcctcatgctggtggcccattacgcgatcattggaccgggccttcaagccaaggctacgcgcgaggcccagaagagaaccgctgccgggatcatgaaaaaccctacagttgatggaatcgtggccattgacctggatcccgtcgtgtatgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgtgagcatggccaacatcttccgcggctcctacctggccggggctggactcgccttttctctgatgaaaagcctgggcgggggaagacggggcacaggggcgcagggagaaacgctcggcgagaagtggaagcgccagcttaatcagctgtccaaatctgagttcaacacctataagagaagcggcattatggaggttgaccggtccgaagccaaagaggggctgaagagaggagagacaaccaaacacgctgtctctcgcggcacagccaagctccggtggtttgtggaaagaaatctggtgaagccggaggggaaagtcatcgatcttggatgtggccgcgggggatggagctactattgcgctggcctgaagaaagttaccgaagtgaagggctacacgaaagggggacccggccacgaggaacctattcccatggccacatacgggtggaacctcgtgaagctgcattccggaaaagacgtcttctttgtgcctcccgagaagtgtgataccctgctctgcgacatcggcgagagctctcctaatccgaccattgaagaggggcggacacttagagttctgaagatggtggaaccctggctgcgcggaaaccaattctgtatcaaaattctcaatccttatatgccctccgtcgtggagaccctggagcagatgcagcggaagcacggcggcatgcttgttagaaaccctctgagccgcaattctacacatgaaatgtactgggtgtcctgcgggacgggaaacatcgtcagcgcgatcaatatgacctctcggatgctcctgaacagatttacaatggcccaccgcaaacccacctatgagcgggatgtggacctgggcgctgggacaagacacgtggccgtcgaaccggaggttgctaacctcgatattatcggacagcgcattgaaaatatcaagcatgagcacaaatccacctggcattacgacgaggataacccttataagacgtgggcctaccacggcagctatgaagtgaagccctccgggagcgcttctagcatggtgaatggagtcgtgaaactgcttaccaagccctgggacgttattcctatggtgacacaaatcgccatgaccgatacaacccccttcggccagcagagagtctttaaagagaaggtggacacacggacccctaaagcgaagcgcggcacggcccaaatcatggaagttacagctaagtggctgtgggggttcctctccagaaacaaaaagccgcggatttgtaccagagaggaatttacccggaaagtgcgctctaatgccgctatcggagccgtcttcgtggacgagaaccagtggaatagcgccaaggaggcggttgaagatgagagattttgggacctggtgcatcgggaacgcgagcttcacaaacagggcaagtgcgctacatgcgtctacaacatgatggggaagagagagaagaagctgggagagttcggcaaagccaaggggtcccgggccatttggtacatgtggctcggcgctcgcttcctggagtttgaagccctgggattcatgaatgaggatcactggttttctagagaaaacagcctctccggcgtggagggggagggactgcataaacttggctatatcctgcgggacatttctaagatcagcgggggaaatatgtacgctgatgacacggccggctgggatacccgcatcacagaagacgatctccagaacgaggcgaaaattaccgacatcatggaacccgagcacgccctgcttgctaattccattttcaagctgacatatcaaaacaaggtcgtgagagttcagcggcctgccaaaaatgggaccgtgatggatgtcatcagccgcagagaccagcggggctctggacaggtgggcacatacgggctcaacacctttacgaacatggaagctcaactgattcgccagatggagtccgagggaatcttcagcccctctgaactggagacccctaatctcgccgaaagagtgctggattggcttgagaagcatggcgttgaacggctgaaaagaatggcgatctccggggacgactgtgtggtcaagcccattgatgaccgctttgccacagctctcaccgccctgaacgatatgggaaaagtgcggaaggacatcccgcagtgggagcctagcaagggctggaatgattggcagcaagttcccttctgctcccaccactttcatcagcttattatgaaagacgggagagagatcgtggtcccttgtcgcaaccaggatgaactggtgggccgggctagagtctctcagggagccggctggagcctccgcgagacagcttgcctggggaagtcctatgcccaaatgtggcagctgatgtacttccaccggagagacctccgcctggcggccaatgctatttgtagcgccgtgcccgttgattgggtgcctacctctcggacgacatggtccatccatgcccaccatcagtggatgaccacagaagacatgcttagcgtctggaacagagtgtggattgaggaaaatccctggatggaggataaaacccacatctctagctgggaggacgttccgtatctgggaaagcgcgaagaccaatggtgcggctccctcatcgggctgacggctcgggccacctgggcgacaaacattcaggtggctatcaatcaggtcagacggcttattggaaacgagaattacctggattacatgacctctatgaaaagatttaagaacgaaagcgaccctgagggcgccctctggtga

SEQ ID NO: 18577 - RNA, 9879 nt, synthetic construct
  misc_feature 1..9879: note = derived and/or modified CDS sequence (opt5) from DENV-1__HM181942__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatctccgaagctgaacccgacgatgtggactgttggtgcaatgccacagatacctgggtgacgtatggaacctgttctcaaacaggcgagcacagacgggacaagcgcagcgttgccctcgctcctcatgtggggctgggactggagaccagaacagaaacctggatgtcctctgagggcgcctggaaacagattcagcgggttgaaacgtgggctctccgccaccccggctttacagtgatcgccctgttccttgcgcatgccattgggaccagcatcacacagaagggaatcatttttatcctgctcatgctggtcaccccttccatggctatgagatgcgtgggcattgggagccgggatttcgttgagggactttctggcgccacctgggtggacgtcgtgctggagcacgggtcctgtgtgacaacgatggctaaggataaacccaccctcgacatcgaactgctgaagacagaggtcaccaaccctgccgttctccgcaaactgtgcattgaagcgaagatcagcaatacaaccacggattctagatgtccgacacaaggagaggccacccttgtggaagaacaagacgctaactttgtgtgccggcgcaccttcgtcgatagaggctggggcaatgggtgtggactgtttggcaaagggtccctcattacatgcgccaagttcaagtgcgtgaccaaactggagggaaagatcgttcagtacgaaaaccttaaatatagcgtgatcgtcacagtgcacacgggcgaccagcatcaagttgggaatgagtctaccgaacacggaacaaccgctacaattacaccccaggccccttccacggagatccagctgaccgactacggcgccctcacactggattgtagcccccggaccggcctggactttaacgaaatggtgctcctgacaatgaaggagaaatcctggcttgtccataagcagtggttcctggatctccctctgccctggacctctggggctagcacgtcccaagagacatggaatcgccaggaccttctggtgacctttaaaacagcgcacgccaagaagcaggaagtcgtggttctcggaagccaagagggcgctatgcacaccgccctgaccggggccacagaaattcagacgtctggaaccacaaccatcttcgctggccatctgaaatgcagactcaagatggataaactgacacttaaggggatgtcctatgtgatgtgtaccggcagcttcaaactggagaaggaagtcgccgagacgcagcacggaacagtgctcgttcagattaagtacgagggcaccgacgcgccgtgcaaaatccctttttctacccaagatgaaaagggggtgacacagaacggacggctgatcaccgctaatcccattgtcacagacaaagagaagcctgtgaacatcgaagccgagccgcccttcggcgagagctatattgtgatcggggccggagaaaaagctctgaaactttcctggtttaagaaaggctctagcattgggaagatgttcgaggccacggctagaggcgcccgccggatggcgatcctcggagataccgcctgggactttggctccatcgggggagttttcacaagcgtcggcaaactggtgcatcagatttttgggaccgcttacggagtgctgttctctggcgtctcctggacaatgaagatcgggattggcgtgctcctgacctggcttggactgaatagcagatctacgtccctcagcatgacctgtatcgccgttggcctggtgacactgtaccttggggtcatggtgcaggctgattccggatgcgttattaactggaaaggccgcgaactcaagtgtgggtctggaatctttgtgaccaatgaggtccacacatggaccgaacaatataagttccaggccgacagccctaaacggctgtccgcggccattggcaaggcttgggaggagggggtgtgcggcatcagatctgccacacgcctggaaaacatcatgtggaaacagattagcaacgagctcaatcatatcctgcttgaaaacgacatgaagtttaccgttgtggtcggagatgtggctggcattctggcccaggggaaaaagatgatccggccgcaacccatggagtacaaatattcctggaaaagctggggaaaggccaagattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgattcttatacccaggtttgcgaccaccggctgatgtccgccgctattaaagatagcaaggccgtgcacgccgacatgggctactggatcgaatctgagaaaaatgaaacgtggaaacttgctagagcctccttcatcgaggtgaagacatgtatttggcccaaaagccataccctctggtctaacggggtcctggaaagcgagatgatcattccgaagatctatggaggccctatttcccaacacaattaccgccccgggtactttacacagaccgcgggaccttggcatctgggcaaactcgagctggatttcgacctttgcgaagggacaaccgtggttgtggatgagcactgcggaaaccggggccccagcctgagaacgaccacagtcaccggcaagatcatccacgaatggtgttgccggtcttgtacactccctcccctgcgctttaaaggggaggacggatgctggtatggcatggagattagaccggtgaaggaaaaggaggaaaatctggttaaatccatggtgagcgctgggtccggagaggtcgactctttcagccttggcctcctgtgtatctccattatgatcgaagaggtgatgcggtctagatggagccgcaagatgctgatgaccgggacgctcgccgtctttttcctgcttattatgggacagctgacatggaacgatctcatccggctgtgcattatggtgggcgccaatgcttccgacagaatgggcatggggatgacctacctggcccttatggcgacatttaaaatgcgccctatgttcgctgtcggactgctctttagacggctgacctctcgcgaggtgctcctgcttaccatcggcctgagcctcgtggcctccgtcgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggttctgtctattgtgtccctttttcccctgtgtctcagcaccacgtctcagaagacaacctggctgcctgtgctcctggggtcccttggatgcaaaccgctgaccatgttcctgatcgccgagaataagatttggggcagaaaaagctggcccctcaacgaaggcatcatggcggtcgggatcgtgtccattctgcttagctctctgctcaagaacgatgttcctctggccggacccctcatcgctggcgggatgctgattgcctgttacgtgatcagcggatcctctgctgaccttagcctggagaaagccgccgaggtctcctgggaagaggaagctgagcattctggcgcgagccacaatattctggtggaagttcaggatgacgggacaatgaagatcaaagatgaggagcgggacgataccctcacaatcctgcttaaggccacgctgctcgctgtgtccggagtctatcctctgtctattcccgccaccctcttcgtgtggtacttttggcaaaagaaaaagcagcgcagcggcgtcctgtgggacacacctagccctcccgaagtggagagagccgttcttgatgacggcatctatcggattatgcagcgcgggctgctgggaagaagccaggtgggcgtcggggtgttccaagaaaacgtttttcataccatgtggcacgtgacacggggagctgtcctcatgtaccagggcaaacgcctggagccctcttgggcctccgtgaagaaagaccttatcagctacgggggaggctggagactgcagggctcttggaataccggggaggaagtgcaggttattgcggtcgagcccggaaagaaccctaagaatgtgcaaacggctcccggcaccttcaaaacatccgaaggggaggtgggagccatcgccctcgattttaagccgggcaccagcgggtcccctattgtcaaccgggaaggaaaaatcgtgggcctgtatggcaatggggttgtgacaacctctggaacatacgtcagcgctatcgcccaggcgaaggcttcccaggagggccccctccctgagattgaagacgaggtgttcagaaaacgcaacctgacgatcatggatcttcaccccgggagcggaaagacccggagatatctgcccgccattgttcgcgaagccatcaagcggaaactgagaacactcattctggctcctacccgcgtggtcgcctctgagatggctgaagcccttaagggcatgccgatccggtaccaaaccacagcggtgaaatccgagcatacggggaaggagatcgttgacctgatgtgccacgccacctttacaatgagactcctgagccccgtgcgcgtccctaattataacatgattatcatggatgaagctcatttcaccgacccctctagcattgccgctcggggctacatctccacaagagtgggaatgggcgaggccgccgctatttttatgaccgcgacgcctcccgggtctgtggaagccttccctcagagcaatgctgtcatccaggatgaggaacgggacatcccggagcgctcctggaactctggatatgagtggattacagattttcccggcaaaaccgtttggttcgtgcctagcatcaagtccgggaatgacattgccaactgtctgagaaagaatggaaaacgggtgatccagctcagccgcaagaccttcgatacagaataccagaagaccaagaacaacgactgggactacgtcgtgacaaccgatatttctgagatgggcgccaattttagagctgaccgggttatcgatcccagacgctgccttaaacctgtgattctgaaggacgggcccgaacgggtcatcctggccggcccgatgcctgtgacggttgcgtccgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagagcgcggccattgatggggagtatcggctcagaggagaggctcgcaaaacatttgtggaactgatgagacggggcgacctgcctgtctggctctcctacaaggtggcctctgaggggttccaatatagcgatcgcagatggtgctttgacggcgaacggaacaatcaggtccttgaggaaaacatggatgtggagatctggaccaaagagggagaacgcaagaaactgagaccgcggtggctggacgctagaacgtactccgaccccctcgccctgcgcgagttcaaggaatttgctgccggccggagatctgttagcggggatcttatcctggagattggaaagctccctcagcacctgacccagcgcgcgcaaaatgccctggacaacctcgtgatgcttcataattccgaacagggcgggcgggcttatagacacgccatggaggagctgcccgatacaatcgaaaccctgatgctcctggctcttattgccgtgctgacaggaggcgtcaccctcttctttctgagcggccgggggctgggaaaaacatctatcggcctcctttgtgttatggcctccagcgtgctgctgtggatggcttctgtggagcctcattggattgcggcctccatcatcctcgagttctttctgatggtccttctgattcccgagccggaccgccagagaacccctcaggataaccaactcgcttacgtggttatcgggctgctgttcatgattctcacggtggccgccaatgagatgggacttctggaaacaaccaagaaagacctgggcatcgggcacgtcgctgtggagaaccaccatcacgccgcgatgctcgatgtcgacctgcatcccgccagcgcttggaccctttacgccgtggctacaaccattatcacacctatgatgcggcacacgattgaaaacaccacagccaatatctctctgaccgcgatcgccaaccaggctgccattctcatgggactggataagggctggcccatcagcaaaatggacattggcgttcctctgctcgctcttgggtgctattcccaggtgaatcccctgacactgaccgccgctgtcctcatgctggtggcccattacgcgatcattggaccgggccttcaagccaaggctacgcgcgaggcccagaagagaaccgctgccgggatcatgaaaaaccctacagttgatggaatcgtggccattgacctggatcccgtcgtgtatgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgtgagcatggccaacatcttccgcggctcctacctggccggggctggactcgccttttctctgatgaaaagcctgggcgggggaagacggggcacaggggcgcagggagaaacgctcggcgagaagtggaagcgccagcttaatcagctgtccaaatctgagttcaacacctataagagaagcggcattatggaggttgaccggtccgaagccaaagaggggctgaagagaggagagacaaccaaacacgctgtctctcgcggcacagccaagctccggtggtttgtggaaagaaatctggtgaagccggaggggaaagtcatcgatcttggatgtggccgcgggggatggagctactattgcgctggcctgaagaaagttaccgaagtgaagggctacacgaaagggggacccggccacgaggaacctattcccatggccacatacgggtggaacctcgtgaagctgcattccggaaaagacgtcttctttgtgcctcccgagaagtgtgataccctgctctgcgacatcggcgagagctctcctaatccgaccattgaagaggggcggacacttagagttctgaagatggtggaaccctggctgcgcggaaaccaattctgtatcaaaattctcaatccttatatgccctccgtcgtggagaccctggagcagatgcagcggaagcacggcggcatgcttgttagaaaccctctgagccgcaattctacacatgaaatgtactgggtgtcctgcgggacgggaaacatcgtcagcgcggtgaatatgacctctcggatgctcctgaacagatttacaatggcccaccgcaaacccacctatgagcgggatgtggacctgggcgctgggacaagacacgtcgccgttgaaccggaggtggctaacctcgatatcattggacagcgcatcgaaaatattaagcatgagcacaaatccacctggcattacgacgaggataacccttataagacgtgggcctaccacggcagctatgaagtgaagccctccgggagcgcttctagcatggtcaatggagtggttaaactgcttaccaagccctgggacgtgatccctatggtcacacaaattgccatgaccgatacaacccccttcggccagcagagagtgtttaaagagaaggttgacacacggacccctaaagcgaagcgcggcacggcccaaatcatggaagtgacagctaagtggctgtgggggttcctctccagaaacaaaaagccgcggatctgtaccagagaggaatttacccggaaagtccgctctaatgccgctattggagccgtgttcgttgacgagaaccagtggaatagcgccaaggaggcggtggaagatgagagattttgggacctggtccatcgggaacgcgagcttcacaaacagggcaagtgcgctacatgcgtgtacaacatgatggggaagagagagaagaagctgggagagttcggcaaagccaaggggtcccgggccatctggtacatgtggctcggcgctcgcttcctggagtttgaagccctgggattcatgaatgaggatcactggttttctagagaaaacagcctctccggcgtcgagggggagggactgcataaacttggctatattctgcgggacatctctaagattagcgggggaaatatgtacgctgatgacacggccggctgggatacccgcatcacagaagacgatctccagaacgaggcgaaaatcaccgacattatggaacccgagcacgccctgcttgctaattccatcttcaagctgacatatcaaaacaaggtggttagagtgcagcggcctgccaaaaatgggaccgtcatggatgtgattagccgcagagaccagcggggctctggacaggtgggcacatacgggctcaacacctttacgaacatggaagctcaactgatccgccagatggagtccgagggaattttcagcccctctgaactggagacccctaatctcgccgaaagagttctggattggcttgagaagcatggcgtggaacggctgaaaagaatggcgatctccggggacgactgtgtcgtgaagcccatcgatgaccgctttgccacagctctcaccgccctgaacgatatgggaaaagttcggaaggacattccgcagtgggagcctagcaagggctggaatgattggcagcaagtgcccttctgctcccaccactttcatcagcttatcatgaaagacgggagagagattgtcgtgccttgtcgcaaccaggatgaactggtcggccgggctagagtgtctcagggagccggctggagcctccgcgagacagcttgcctggggaagtcctatgcccaaatgtggcagctgatgtacttccaccggagagacctccgcctggcggccaatgctatctgtagcgccgttcccgtggattgggtccctacctctcggacgacatggtccattcatgcccaccatcagtggatgaccacagaagacatgcttagcgtgtggaacagagtttggatcgaggaaaatccctggatggaggataaaacccacatttctagctgggaggacgtgccgtatctgggaaagcgcgaagaccaatggtgcggctccctcatcgggctgacggctcgggccacctgggcgacaaacatccaggtcgctattaatcaggtgagacggcttatcggaaacgagaattacctggattacatgacctctatgaaaagatttaagaacgaaagcgaccctgagggcgccctctggtga

SEQ ID NO: 18578 - RNA, 9879 nt, synthetic construct
  misc_feature 1..9879: note = derived and/or modified CDS sequence (opt5) from DENV-1__HM488255__SS-prME
  source 1..9879: mol_type = other RNA
agcgtgaccatgctgctcatgctgatgcccaccgcccttgctttccacctgacgaccagaggcggggagcctcatatgatcgtctccaagcaggaacgggggaaatctctcctgtttaagaccagcgccggcgttaatatgtgcacccttatcgcgatggacctgggggagctctgtgaagatacaatgacctacaaatgcccgcgcatcacagaggctgaacccgacgatgtggactgttggtgcaatgccaccgatacgtgggtgacctatgggacatgttcccaaaccggcgagcacagacgggacaagcgctctgtcgccctggctcctcatgtggggctgggactcgagacaagaaccgaaacgtggatgagctccgagtctgcctggaaacagattcagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtggactcttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcagcacccaagatgaaaagggcgttacacagaacgggcggctgattacggctaatcccatcgtgaccgacaaagagaagcctgtcaacattgaagccgagccgccctttggagagtcttatatcgtgattggcgccggggaaaaagctcttaagctcagctggttcaagaaaggatcctctatcggcaagatgtttgaggccacagctagaggggcccgccggatggcgatcctgggcgataccgcctgggacttcggaagcattggcggggtgtttacatccgttggaaaactggtccatcagatcttcggcaccgcttacggggtgctctttagcggagtgtcttggacgatgaagattggcatcggggtcctgcttacctggctgggcctcaattccagaagcacatctctgtccatgacctgtattgccgtgggactggttacactttacctcggcgtgatggtccaggctgatagcgggtgcgtgatcaactggaaaggacgcgaactgaagtgtggctccgggattttcgttaccaatgaggtgcacacatggaccgaacaatataagtttcaggccgactctcctaaacggctgagcgcggccatcggaaaggcttgggaggagggcgtctgcgggatcagatccgccacgcgcctcgaaaacattatgtggaaacagatctctaacgagctgaatcatattcttctggaaaacgacatgaagttcacagtggttgtgggcgatgtcgctggaatcctcgcccagggcaaaaagatgattcggccgcaacccatggagtacaaatatagctggaagtcctgggggaaggccaaaatcatcggagctgacgtgcagaataccacctttattatcgatggccctaacacacccgaatgtcctgacgatcagagagcgtggaatatttgggaggtggaggactacgggttcggaatctttaccacgaacatttggctgaagctgcgcgatagctatacacaggtctgcgaccaccggcttatgtctgccgctatcaaagattccaaggccgttcacgccgacatgggctactggatcgaaagcgagaaaaatgaaacctggaagctcgctagagcctctttcattgaggtgaagacatgtatctggcccaaatcccataccctgtggagcaacggcgtgctggaatctgagatgattatcccgaagatttatgggggacctatcagccaacacaattaccgccccggctacttcacacagaccgcggggccttggcatctcggaaaactggagcttgattttgacctgtgcgaaggcacgaccgtcgtggttgatgagcactgcgggaaccggggaccctccctcagaacaaccacagtgaccggcaagatcattcacgaatggtgttgccggagctgtacgctgcctcccctgcgcttcagaggcgaggacgggtgctggtatggaatggagatccggccggtcaaagaaaaggaggaaaatcttgtgaagtctatggtttccgctggcagcggggaggtggactccttttctctcggactgctgtgtattagcatcatgattgaagaggtcatgagatcccgctggtctcggaaaatgctcatgacaggcaccctggccgtgttccttctgctcatcatggggcagctgacatggaacgatctgattagactttgcatcatggttggagccaatgctagcgaccgcatgggcatgggcaccacctacctggccctcatggcgacatttaagatgagacctatgttcgctgtggggctgctctttcggcgcctgacgtccagagaggtccttctgctcaccatcggactgtctctggtggccagcgtggaacttcccaactccctggaggaactcggcgatgggctggccatgggaattatgatcctcaaactgcttacagacttccaaagccatcagctgtgggctaccctcctgtctctgacatttattaagaccacgttctcccttcactatgcctggaaaacaatggctatggtcctgagcatcgtttctctctttcccctgtgtctctccaccaccagccagaagacaacctggctgcctgtgcttctgggctctctggggtgcaagccgctcacaatgttcctgattgccgagaataaaatctggggacggcgctcctggccccttaacgaaggcatcatggcggtgggcattgtcagcatcctgctctccagcctgctcaagaacgatgtgcctctggccgggccccttattgctggaggcatgctgatcgcctgttacgttatttctgggagctccgctgacctgtctctcgagaaagccgccgaggtgagctgggaagaggaagctgagcattccggagcgtctcacaatatcctggtcgaagtgcaggatgacggcacgatgaagatcaaagatgaggagagagacgatacccttacaattctgctcaaggccaccctgctcgctgttagcggggtgtatcctctgtccatccccgccacactttttgtctggtacttctggcagaagaagaagcagcggtctggagtgctgtgggacaccccttcccctcccgaagtcgagcgcgccgtgctggatgacggcatttatagaatcatgcagcggggcctcctggggcgctcccaggttggagtgggcgtcttccaagaaaacgtgtttcatacgatgtggcacgttaccagaggggctgtgcttatgtaccagggaaaacggctggagcccagctgggcctctgtcaagaaagacctcatttcctacggcgggggatggagactgcagggcagctggaatacaggcgaggaagtgcaagtgatcgcggttgagcccgggaagaaccctaaaaatgtccaaaccgctcccggaacattcaagaccccggaaggcgaggtgggggccattgccctcgattttaagcctggaacatctggctcccccatcgtgaaccgcgaagggaaaatcgtcggactgtatggcaatggcgtggttacgaccagcgggacatacgtgtccgctattgcccaggcgaaggcttctcaggagggacctcttcccgagatcgaagacgaggtcttccggaaaagaaacctgaccattatggatctgcaccccggcagcgggaagacccgccggtatctccctgccatcgtgagagaagccattaaacgcaagctgcggacacttatcctggctccgacgagagttgtggcctccgagatggctgaagccctcaagggaatgcccatccgctaccaaaccacagcggtcaaaagcgagcataccggcaaggagattgtggacctgatgtgccacgccacatttaccatgcggctgctctctcctgttagagtgcccaattataacatgatcattatggatgaagctcatttcacggacccttccagcatcgccgctcgggggtacatttctacacgcgtcggcatgggagaggccgccgctatctttatgaccgcgacaccccctggcagcgtggaagccttcccgcagtccaatgctgtgatccaggatgaggaaagagacattcccgagcggtcttggaacagcgggtatgagtggatcacagattttcctggaaaaaccgtctggttcgttccctccattaagtctggcaatgacatcgccaactgtcttcgcaaaaatgggaagagagtgattcagctgagccggaagacatttgataccgaataccagaaaacgaagaacaacgactgggactacgtggtcacaaccgatatctccgagatgggagccaatttcagagctgaccgcgtgattgatcctcggagatgcctgaaacccgttatcctcaaggacggcccggaacgcgtgatcctggccgggcctatgcccgtcacagtggcgagcgctgcccagcggagaggccgcattggacggaaccacaataaagagggcgatcagtatatctacatggggcagccccttaacaatgacgaggatcatgcccactggaccgaagctaagatgctgctcgacaacattaatacgcctgagggaatcattcccgccctgttcgaacctgagagagaaaagtctgcggccatcgatggcgagtatcgcctgagaggggaggctcggaaaacctttgttgaactcatgcgcagaggagaccttccggtgtggctgtcctacaaggtcgccagcgagggcttccaatattccgatcggcgctggtgctttgacggggaaagaaacaatcaggtgctggaggaaaacatggatgtcgagatctggacaaaagagggcgaacggaagaaactcagaccccgctggctggacgctcggacctactctgaccctcttgccctgagagagttcaaggaatttgctgccggacgccggagcgtgtccggcgatctcattctggagatcgggaaactgccccagcacctcacacagagagcgcaaaatgcccttgacaacctggttatgctgcataattctgaacagggaggccgggcttatcgccacgccatggaggagctccctgataccattgaaacactgatgcttctggctctcatcgccgtgctgaccgggggagtgacgctgttctttctcagcggcagaggccttgggaagacatccattggactgctgtgtgtcatggccagctctgttctcctgtggatggcttccgtggagccccattggatcgcggccagcatcattcttgagttctttctgatggtgctcctgatcccggagcctgaccggcagcgcacaccccaggataaccaactggcttacgtcgtgattggcctccttttcatgatcctgaccgttgccgccaatgagatggggctgctcgaaacaaccaagaaagacctgggaattggccacgtggctgtcgggaaccaccatcacgccgcgatgcttgatgtggacctgcatcctgcctctgcttggacactctacgccgtcgctacgaccatcattacacccatgatgagacacaccatcgagaacacaaccgccaatatctccctgacggcgattgccaaccaggctgccatcctgatgggactcgataagggctggcctattagcaaaatggacatcggcgtgccccttctggctctggggtgctattctcaggttaatccgctcaccctgacagccgctgtgcttatgctggtcgcccattacgcgattatcggacctggcctccaagccaaggctacccgggaagcccagaaacgcacagctgccgggatcatgaagaaccccaccgtggatggaattgttgccatcgacctggatcccgtggtctatgacgcgaagtttgagaaacagctgggccagattatgctccttatcctgtgtacgagccaaattctgctcatgagaacaacctgggctctgtgcgaatccatcacacttgccaccgggcctctgaccacactctgggagggatctccgggcaagttctggaatacgaccatcgctgtgagcatggccaacatttttcggggctcctacctggccggggctggactggccttcagcctcatgaaatcccttggccgcgggagacggggaacaggcgcgcagggggagaccctgggagaaaagtggaaaagacagctgaatcagctctctaagagcgagttcaacacatataagcgctccggcatcatggaagtggaccggtctgaggccaaagaaggcctgaagagaggggagaccacgaaacacgctgttagccgcggaacagccaaacttcggtggtttgtcgagagaaatctggtgaaacccgaaggcaaggtgattgatctcgggtgtggacgcggcgggtggtcctactattgcgctggactgaagaaagtcaccgaggttaagggctacaccaaaggcgggcctggacacgaagaacccatccctatggccacatacggctggaacctggtgaagctccattctgggaaagacgtgttctttattccccctgaaaagtgtgatacccttctgtgcgacatcggagagagctccccgaatcccacaattgaggaaggccggacgctgagagtcctcaaaatggtggagccttggctgcgcgggaaccaattctgtatcaagatccttaatccctatatgcctagcgttgtggaaaccctggagcagatgcagcggaagcacggaggcatgctcgtcagaaaccccctgtctcgcaattccacacatgagatgtactgggtgagctgcggcaccgggaacattgtttctgcggtgaatatgacatcccggatgctgctcaacagatttaccatggcccaccgcaaaccgacgtatgaaagagatgtcgacctgggagctggcacccggcacgtggccgtggagcctgaagtcgctaaccttgatatcattgggcagcgcatcgagaatattaagcatgaacacaaaagcacatggcattacgacgaggataacccctataagacctgggcctaccacggatcttatgaggttaaaccctccggcagcgcttccagcatggtgaatggggtggtcaagctgctcacaaagccttgggacgtgatccccatggttacccaaatcgccatgacagataccacgcctttcggacagcagagagtgtttaaagaaaaggtcgacacacggaccccgaaagcgaagagaggcaccgcccaaattatggaggtgacagctaaatggctgtggggcttcctttctcggaacaagaagccccgcatctgtacgagagaagagtttacccggaaagttcgcagcaatgccgctattggggccgtgttcgtcgacgaaaaccagtggaactccgccaaggaggcggtggaggatgaaagattttgggacctggttcatcgggagcgcgaactccacaaacagggaaagtgcgctacatgcgtgtacaacatgatgggcaaaagagagaagaagctgggggagttcggaaaagccaagggctctcgggccatctggtacatgtggctgggggctcgctttctcgagttcgaggccctgggcttcatgaatgaagatcactggtttagcagagagaactccctttctggagtcgaaggcgaggggctgcataaactcggatatattctgcgggacatcagcaagatccctggcgggaatatgtacgctgatgacaccgccggatgggatacacgcattaccgaggacgatcttcagaacgaagcgagaatcacagacattatggagcccgaacacgccctgctcgctaaatccatcttcaagctgacctatcaaaataaagtggtccgggtgcagcgccctgccaagaacggcacggttatggatgtgatttctagacgggaccagagagggagcggccaggtcggaacctacggcctgaatacatttaccaacatggaggctcaactcatccgccagatggaatccgaggggatcttcagcccctctgagctggaaacaccgaaccttgccgagcgggtgctggattggctcgaaaagtatggagtggagagactgaaacgcatggcgatttccggcgacgactgtgttgtgaagcctatcgatgaccggtttgccaccgctcttacggccctgaatgatatggggaaagtcagaaaggacattccccagtgggaacctagcaaaggatggaacgattggcagcaagtgcccttctgctctcatcactttcaccagctcatcatgaaggacggccgcgagattgttgtgccttgtcggaatcaggatgagctggtcgggagagctcgcgtgtcccagggcgccggatggagcctgcgggaaacagcttgcctcggcaagtcctacgcccaaatgtggcagctgatgtatttccatagacgcgaccttcggctggcggccaacgctatctgttctgccgtccccgtggattggattccgaccagcagaacaacctggtccatccacgcccatcaccagtggatgacgaccgaggacatgctcagcgtttggaatcgggtgtggatcgaagagaacccttggatggaagataaaacacatatttcttcctggggagacgtcccctacctgggaaagagagaggaccaatggtgcggcagccttatcgggctgaccgctcgcgccacatgggcgaccaatattcaggtggctatcaaccaggttcggagactcattggaaatgagaactacctggattatatgacatctatgaaacgctttaagaatgaaagcgaccccgagggcgccctgtggtga

SEQ ID NO: 18579 - RNA, 9879 nt, synthetic construct
  misc_feature 1..9879: note = derived and/or modified CDS sequence (opt5) from DENV-1__HM181944__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggaactctgtgaagatacaatgacctacaaatgcccgcgcatctccgaggctgaacccgacgatgtggactgttggtgcaatgccacagatacctgggtgacgtatggaacctgttctcaaacaggcgagcacagacgggacaagcgcagcgtcgccctggctcctcatgtggggctgggactcgagaccagaacagaaacctggatgtcctctgagggcgcctggaaacagattcagcgggttgaaacgtgggctctgcgccaccccggcttcacagtgatcgccctttttctggcgcatgccattgggaccagcatcacacagaagggaatcattttcatcctcctgatgcttgtcaccccttccatggctatgagatgcgtgggcattgggagccgggattttgttgagggactgtctggcgccacctgggtggacgtcgtgctcgagcacgggtcctgtgtgacaacgatggctaaggataaacccaccctggacatcgaactgctcaagacagaggtcaccaaccctgccgttctgcgcaaactttgcattgaagcgaagatcagcaatacaaccacggattctagatgtccgacacaaggagaggccaccctggtggaagaacaagacgctaacttcgtgtgccggcgcacctttgtcgatagaggctggggcaatgggtgtggactcttcggcaaagggtccctgattacatgcgccaagtttaagtgcgtgaccaaacttgagggaaagatcgttcagtacgaaaacctgaaatatagcgtgatcgtcacagtgcacacgggcgaccagcatcaagttgggaatgagtctaccgaacacggaacaaccgctacaattacaccccaggccccttccacggagatccagctcaccgactacggcgccctgacactggattgtagcccccggaccggcctcgacttcaacgaaatggtgctgcttacaatgaaggagaaatcctggctggtccataagcagtggtttctcgatctgcctcttccctggacctctggggctagcacgtcccaagagacatggaatcgccaggacctgctcgtgaccttcaaaacagcgcacgccaagaagcaggaagtcgtggttctgggaagccaagagggcgctatgcacaccgccctgaccggggccacagaaattcagacgtctggaaccacaaccatctttgctggccatctcaaatgcagactgaagatggataaacttacactgaaggggatgtcctatgtgatgtgtaccggcagcttcaaactcgagaaggaagtcgccgagacgcagcacggaacagtgctggttcagattaagtacgagggcaccgacgcgccgtgcaaaatccctttctctacccaagatgaaaagggggtgacacagaacggacggctgatcaccgctaatcccattgtcacagacaaagagaagcctgtgaacatcgaagccgagccgccctttggcgagagctatattgtgatcggggccggagaaaaagctcttaagctctcctggttcaagaaaggctctagcattgggaagatgtttgaggccacggctagaggcgcccgccggatggcgatcctgggagataccgcctgggacttcggctccatcgggggagtttttacaagcgtcggcaaactggtgcatcagattttcgggaccgcttacggagtgctcttttctggcgtctcctggacaatgaagatcgggattggcgtgctgcttacctggctgggactcaatagcagatctacgtccctgagcatgacctgtatcgccgttggcctggtgacactttacctcggggtcatggtgcaggctgattccggatgcgttattaactggaaaggccgcgaactgaagtgtgggtctggaatcttcgtgaccaatgaggtccacacatggaccgaacaatataagtttcaggccgacagccctaaacggctgtccgcggccattggcaaggcttgggaggagggggtgtgcggcatcagatctgccacacgcctcgaaaacatcatgtggaaacagattagcaacgagctgaatcatatccttctggaaaacgacatgaagttcaccgttgtggtcggagatgtggctggcattctcgcccaggggaaaaagatgatccggccgcaacccatggagtacaaatattcctggaaaagctggggaaaggccaagattatcggcgctgacgtgcagaatacgacatttatcattgatgggcctaacacccccgaatgtcctgacgatcagagagcgtggaatatctgggaggtcgaggactacggattcggcatttttaccacaaacatctggctgaagctgcgcgattcttatacccaggtttgcgaccaccggcttatgtccgccgctattaaagatagcaaggccgtgcacgccgacatgggctactggatcgaatctgagaaaaatgaaacgtggaagctcgctagagcctccttcatcgaggtgaagacatgtatttggcccaaaagccataccctgtggtctaacggggtcctggaaagcgagatgatcattccgaagatctatggaggccctatttcccaacacaattaccgccccgggtacttcacacagaccgcgggaccttggcatctcggcaaactggagcttgattttgacctgtgcgaagggacaaccgtggttgtggatgagcactgcggaaaccggggccccagcctcagaacgaccacagtcaccggcaagatcatccacgaatggtgttgccggtcttgtacactgcctcccctgcgcttcaaaggggaggacggatgctggtatggcatggagattagaccggtgaaggaaaaggaggaaaatcttgttaaatccatggtgagcgctgggtccggagaggtcgactcttttagcctcggcctgctgtgtatctccattatgatcgaagaggtgatgcggtctagatggagccgcaagatgctcatgaccgggacgctggccgttttctttcttctgattatgggacagctcacatggaacgatctgatccggctgtgcattatggtgggcgccaatgcttccgacagaatgggcatggggatgacctaccttgccctgatggcgacattcaaaatgcgccctatgtttgctgtcggactcctgttcagacggctcacctctcgcgaggtgctgcttctgaccatcggcctcagcctggtggcctccgtcgaactgcccaacagccttgaggaactgggggatggactcgccatgggcatcatgattctgaagctcctgacagactttcaatctcatcagctttgggctacgctgctctccctgaccttcatcaaaacaacctttagcctgcactatgcctggaagacaatggctatggttctttctattgtgtccctgttccccctctgtctgagcaccacgtctcagaagacaacctggctccctgtgctgcttgggtccctgggatgcaaaccgctgaccatgtttctcatcgccgagaataagatttggggcagaaaaagctggcccctgaacgaaggcatcatggcggtcgggatcgtgtccattcttctgagctctctcctgaagaacgatgttcctctcgccggacccctgatcgctggcgggatgcttattgcctgttacgtgatcagcggatcctctgctgacctgagcctggagaaagccgccgaggtctcctgggaagaggaagctgagcattctggcgcgagccacaatattctcgtggaagttcaggatgacgggacaatgaagatcaaagatgaggagcgggacgataccctgacaatccttctgaaggccacgctcctggctgtgtccggagtctatcctctctctattcccgccaccctgttcgtgtggtacttctggcaaaagaaaaagcagcgcagcggcgtcctttgggacacacctagccctcccgaagtggagagagccgttctggatgacggcatctatcggattatgcagcgcgggctgctcggaagaagccaggtgggcgtcggggtgtttcaagaaaacgttttccataccatgtggcacgtgacacggggagctgtcctgatgtaccagggcaaacgccttgagccctcttgggcctccgtgaagaaagacctgatcagctacgggggaggctggagactccagggctcttggaataccggggaggaagtgcaggttattgcggtcgagcccggaaagaaccctaagaatgtgcaaacggctcccggcacctttaaaacatccgaaggggaggtgggagccatcgccctggatttcaagccgggcaccagcgggtcccctattgtcaaccgggaaggaaaaatcgtgggcctctatggcaatggggttgtgacaacctctggaacatacgtcagcgctatcgcccaggcgaaggcttcccaggagggccccctgcctgagattgaagacgaggtgtttagaaaacgcaaccttacgatcatggatctgcaccccgggagcggaaagacccggagatatctgcccgccattgttcgcgaagccatcaagcggaaactcagaacactgattcttgctcctacccgcgtggtcgcctctgagatggctgaagccctgaagggcatgccgatccggtaccaaaccacagcggtgaaatccgagcatacggggaaggagatcgttgacctcatgtgccacgccaccttcacaatgagactgctgagccccgtgcgcgtccctaattataacatgattatcatggatgaagctcattttaccgacccctctagcattgccgctcggggctacatctccacaagagtgggaatgggcgaggccgccgctattttcatgaccgcgacgcctcccgggtctgtggaagcctttcctcagagcaatgctgtcatccaggatgaggaacgggacatcccggagcgctcctggaactctggatatgagtggattacagatttccccggcaaaaccgtttggtttgtgcctagcatcaagtccgggaatgacattgccaactgtctcagaaagaatggaaaacgggtgatccagcttagccgcaagaccttcgatacagaataccagaaaaccaagaacaacgactgggactacgtcgtgacaaccgatatttctgagatgggcgccaatttcagagctgaccgggttatcgatcccagacgctgcctgaaacctgtgattctgaaggacgggcccgaacgggtcatcctcgccggcccgatgcctgtgacggttgcgtccgctgcccagagacgcggacggatcggcagaaaccacaataaggagggggatcagtatatttacatgggacagcccctgaacaatgacgaggatcatgcccactggacagaagctaaaatgcttctggacaacatcaatacccccgagggcattatccctgccctctttgaacccgagcgcgaaaagagcgcggccattgatggggagtatcggctgagaggagaggctcgcaaaacattcgtggaactgatgagacggggcgacctccctgtctggctttcctacaaggtggcctctgaggggtttcaatatagcgatcgcagatggtgcttcgacggcgaacggaacaatcaggtcctggaggaaaacatggatgtggagatctggaccaaagagggagaacgcaagaaactgagaccgcggtggctcgacgctagaacgtactccgaccccctggcccttcgcgagtttaaggagttcgctgccggccggagatctgttagcggggatctgatcctcgagattggaaagctgcctcagcacctgacccagcgcgcgcaaaatgccctcgacaaccttgtgatgctgcataattccgaacagggcgggcgggcttatagacacgccatggaggagctgcccgatacaatcgaaaccctcatgctgcttgctctgattgccgtgctcacaggaggcgtcaccctgtttttcctgagcggccgggggctcggaaaaacatctatcggccttctgtgtgttatggcctccagcgtgctgctctggatggcttctgtggagcctcattggattgcggcctccatcatcctggaatttttccttatggtcctgctcattcccgagccggaccgccagagaacccctcaggataaccaactggcttacgtggttatcgggctgctctttatgattcttacggtggccgccaatgagatgggactgctggaaacaaccaagaaagacctcggcatcgggcacgtcgctgtggagaaccaccatcacgccgcgatgctggatgtcgaccttcatcccgccagcgcttggaccctgtacgccgtggctacaaccattatcacacctatgatgcggcacacgattgaaaacaccacagccaatatctctctcaccgcgatcgccaaccaggctgccattctgatgggactggataagggctggcccatcagcaaaatggacattggcgttcctctccttgctctggggtgctattcccaggtgaatcccctgacactcaccgccgctgtcctgatgcttgtggcccattacgcgatcattggaccgggcctgcaagccaaggctacgcgcgaggcccagaagagaaccgctgccgggatcatgaaaaaccctacagttgatggaatcgtggccattgacctcgatcccgtcgtgtatgacgcgaagttcgaaaaacagctgggccagatcatgctgctcattctttgtacctctcaaatcctgctgatgcggacaacctgggctctctgcgagagcattacgctggccacagggccccttaccacactgtgggagggatcccctggcaagttttggaataccaccatcgctgtgagcatggccaacatcttccgcggctcctacctcgccggggctggactggccttctctctgatgaaaagcctcggcgggggaagacggggcacaggggcgcagggagaaacgcttggcgagaagtggaagcgccagctgaatcagctgtccaaatctgaatttaacacctataagagaagcggcattatggaggttgaccggtccgaagccaaagaggggctcaagagaggagagacaaccaaacacgctgtctctcgcggcacagccaagctgcggtggttcgtggaaagaaatcttgtgaagccggaggggaaagtcatcgatctgggatgtggccgcgggggatggagctactattgcgctggcctcaagaaagttaccgaagtgaagggctacacgaaagggggacccggccacgaggaacctattcccatggccacatacgggtggaacctggtgaagctgcattccggaaaagacgtctttttcgtgcctcccgagaagtgtgataccctcctttgcgacatcggcgagagctctcctaatccgaccattgaagaggggcggacactgagagttctgaagatggtggaaccctggctccgcggaaaccaattttgtatcaaaattctgaatccttatatgccctccgtcgtggagacccttgagcagatgcagcggaagcacggcggcatgctggttagaaaccctctcagccgcaattctacacatgaaatgtactgggtgtcctgcgggacgggaaacatcgtcagcgcggtgaatatgacctctcggatgctgctgaacagattcacaatggcccaccgcaaacccacctatgagcgggatgtggacctcggcgctgggacaagacacgtcgccgttgaaccggaggtggctaacctggatatcattggacagcgcatcgaaaatattaagcatgagcacaaatccacctggcattacgacgaggataacccttataagacgtgggcctaccacggcagctatgaagtgaagccctccgggagcgcttctagcatggtcaatggagtggttaaacttctgaccaagccctgggacgtgatccctatggtcacacaaattgccatgaccgatacaaccccctttggccagcagagagtgttcaaagagaaggttgacacacggacccctaaagcgaagcgcggcacggcccaaatcatggaagtgacagctaagtggctctgggggtttctgtccagaaacaaaaagccgcggatctgtaccagagaggagttcacccggaaagtccgctctaatgccgctattggagccgtgtttgttgacgagaaccagtggaatagcgccaaggaggcggtggaagatgagagattctgggaccttgtccatcgggaacgcgagctgcacaaacagggcaagtgcgctacatgcgtgtacaacatgatggggaagagagagaaaaagctcggagagtttggcaaagccaaggggtcccgggccatctggtacatgtggctgggcgctcgcttcctggagttcgaagccctcggatttatgaatgaggatcactggttctctagagaaaacagcctgtccggcgtcgagggggagggacttcataaactgggctatattctccgggacatctctaagattagcgggggaaatatgtacgctgatgacacggccggctgggatacccgcatcacagaagacgatctgcagaacgaggcgaaaatcaccgacattatggaacccgagcacgcccttctggctaattccatctttaagctcacatatcaaaacaaggtggttagagtgcagcggcctgccaaaaatgggaccgtcatggatgtgattagccgcagagaccagcggggctctggacaggtgggcacatacgggctgaacaccttcacgaacatggaagctcaactgatccgccagatggagtccgagggaatttttagcccctctgaactcgagacccctaatctggccgaaagagttcttgattggctggagaagcatggcgtggaacggctcaaaagaatggcgatctccggggacgactgtgtcgtgaagcccatcgatgaccgcttcgccacagctctgaccgcccttaacgatatgggaaaagttcggaaggacattccgcagtgggagcctagcaagggctggaatgattggcagcaagtgcccttttgctcccaccacttccatcagctgatcatgaaagacgggagagagattgtcgtgccttgtcgcaaccaggatgaactcgtcggccgggctagagtgtctcagggagccggctggagcctgcgcgagacagcttgcctggggaagtcctatgcccaaatgtggcagctcatgtactttcaccggagagacctgcgccttgcggccaatgctatctgtagcgccgttcccgtggattgggtccctacctctcggacgacatggtccattcatgcccaccatcagtggatgaccacagaagacatgctgagcgtgtggaacagagtttggatcgaggaaaatccctggatggaggataaaacccacatttctagctgggaggacgtgccgtatctcggaaagcgcgaagaccaatggtgcggctccctgatcgggcttacggctcgggccacctgggcgacaaacatccaggtcgctattaatcaggtgagacggctgatcggaaacgagaattacctcgattacatgacctctatgaaaagattcaagaacgaaagcgaccctgagggcgccctgtggtga

SEQ ID NO: 18580 - RNA, 9879 nt, synthetic construct
  misc_feature 1..9879: note = derived and/or modified CDS sequence (opt5) from DENV-1__HM181946__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagagcaggacgctaacttcgtgtgccggcgcacatttgtggatagaggctggggcaatgggtgtggactcttcggcaaagggtctctgatcacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatccggtacgagggcacagacgcgccgtgcaagatccctttctccacccaagatgaaagaggggttacacagaacggacgcctgattacggctaatcccatcgtgaccgacaaagagaagcctgtcaacattgaagccgagcccccctttggcgagagctatatcgtgattggggccggagaaaaagctcttaagctctcttggttcaaaaagggcagctccatcgggaagatgtttgaggccacagctcggggcgccagacgcatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctcggtccacaagcttctctatgacctgtattgccgtgggcctggttacactgtaccttggggtgatggtccaggctgattccggatgcgtgatcaactggaaaggcagagaactcaagtgtgggagcggaatttttgttaccaatgaggtgcacacatggaccgaacaatataaattccaggccgactcccctaagcgcctgtctgcggccatcggcaaggcttgggaggagggggtctgcggcatccggagcgccacgagactggaaaacattatgtggaaacagatctccaacgagctcaatcatattctgcttgaaaacgacatgaagtttacagtggttgtgggagatgtcgctggcatcctggcccaggggaaaaagatgattcgcccgcaacccatggagtacaaatattcttggcggagctggggaaaggccaaaatcatcggcgctgacgtgcagaataccaccttcattatcgatgggcctaacacacccgaatgtcctgacgatcagagagcgtggaatatttgggaggtggaggactacggatttggcatcttcaccacgaacatttggctcaagctgcgcgattcctatacacaggtctgcgaccaccggctgatgagcgccgctatcaaggattctaaagccgttcacgccgacatgggctactggatcgaatccgagaagaatgaaacctggaaacttgctagagccagcttcattgaggtgaagacatgtatctggcccaaatctcataccctctggtccaacggggtgctggaaagcgagatgattatcccgaagatttatggaggccctatctctcaacacaattaccggcccgggtactttacacagaccgcgggaccttggcatctgggcaagctcgagctggatttcgacctttgcgaagggacgaccgtcgtggttgatgagcactgcggaaaccgcggccccagcctgagaacaaccacagtgaccggcaaaatcattcacgaatggtgttgccggtcctgtacgctccctcccctgagatttcgcggggaggacggatgctggtatggcatggagatccggccggtcaaggaaaaagaggaaaatctggtgaagagcatggtttctgctgggtccggagaggtggacagcttctcccttggcctcctgtgtatttctatcatgattgaagaggtcatgagaagccgctggtccagaaaaatgctgatgacagggaccctcgccgtgtttctgcttctgatcatgggacagctcacatggaacgatctgattcggctgtgcatcatggttggcgccaatgcttctgaccgcatgggcatggggaccacctaccttgccctgatggcgacattcaagatgagacctatgtttgctgtgggactcctgttccggcgcctcacgagcagagaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataaaatctggggccggcgctcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagagagacgataccctgacaattcttctgaaagccaccctcctggctgtttctggagtgtatcctctcagcatccccgccacactgttcgtctggtacttctggcaaaagaaaaagcagcggtccggcgtgctttgggacaccccttctcccccggaagtcgagcgcgccgtgctggatgacggcatttatagaatcatgcagcgggggctgctcggaagaagccaggttggcgtgggggtctttcaagaaaacgtgttccatacgatgtggcacgttacccgcggagctgtgctgatgtaccagggcaaacggcttgagccttcctgggccagcgtcaagaaggacctgatttcttacgggggaggctggagactccagggctcctggaatacaggggaggaagtgcaggtgatcgcggttgagcccggaaaaaaccctaagaatgtccaaaccgctcccggcacatttaaaaccccggaaggggaggtgggagccattgccctggatttcaagcctggcacaagcgggtctcccatcgtgaaccgcgaaggaaaaatcgtcggcctctatggcaatggggtggttacgacctccggaacatacgtgagcgctattgcccaggcgaaggcttcccaggagggccctctgcccgagatcgaagacgaggtctttcggaagagaaaccttaccattatggatctgcaccccgggtctggaaaaacccgccggtatctgcctgccatcgtgagagaagccattaagcgcaaactccggacactgatccttgctccgacgagagttgtggccagcgagatggctgaagccctgaagggcatgcccatccggtaccaaaccacagcggtcaaatccgagcataccgggaaggagattgtggacctcatgtgccacgccacattcaccatgcgcctgctgagccctgttagagtgcccaattataacatgatcattatggatgaagctcattttacggacccttcttccatcgccgctcggggctacattagcacacgcgtcggaatgggcgaggccgccgctatcttcatgaccgcgaccccccctgggtctgtggaagcctttccgcagagcaatgctgtgatccaggatgaggaaagagacattcccgagcggtcctggaactctggatatgagtggatcacagatttccctggcaagaccgtctggtttgttcccagcattaaatccgggaatgacatcgccaactgtctcagaaagaatggaaaacgcgtgattcagctttctcggaagacattcgataccgaataccaaaaaacgaagaacaacgactgggactacgtggtcacaaccgatatcagcgagatgggcgccaatttcagagctgaccgcgtgattgatcctcggagatgcctgaagcccgttatcctgaaagacgggccggaacgcgtgatcctcgccggccctatgcccgtcacagtggcgtccgctgcccagcggagaggacgcattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgggaaaagagcgcggccatcgatggggagtatcgcctgagaggagaggctcggaaaaccttcgttgaactgatgcgcagaggcgacctcccggtgtggctttcttacaaggtcgcctccgaggggtttcaatatagcgatcggagatggtgcttcgacggcgaacgcaacaatcaggtgctggaggaaaacatggatgtcgagatctggacaaaggagggagaacggaaaaagctgagaccccgctggctcgacgctcggacctactccgaccctctggcccttagagagtttaaagaattcgctgccggccggcgctctgtgagcggggatctgattctcgagatcggaaagctgccccagcacctgacacagagagcgcaaaatgccctcgacaaccttgttatgctgcataattccgaacagggcgggcgggcttatcgccacgccatggaggagctgcctgataccattgaaacactcatgctgcttgctctgatcgccgtgctcaccggaggcgtgacgctgtttttcctgtctggcagagggctcggaaaaacaagcattggccttctgtgtgtcatggcctccagcgttctgctctggatggcttctgtggagccccattggatcgcggcctccatcattctggaatttttccttatggtgctgctcatcccggagcctgaccggcagcgcaccccccaggataaccaactggcttacgtcgtgattgggctgctctttatgatccttaccgttgccgccaatgagatgggactgctggaaacaaccaagaaagacctcggcattgggcacgtggctgtcggaaaccaccatcacgccgcgatgctggatgtggaccttcatcctgccagcgcttggacactgtacgccgtcgctacgaccatcattacacccatgatgagacacaccatcgagaacacaaccgccaatatctctctcacggcgattgccaaccaggctgccatcctgatgggcctggataagggctggcctatttccaagatggacatcggggtgcccctccttgctctgggatgctatagccaggttaatccgctgaccctcacagccgctgtgctgatgcttgtcgcccattacgcgattatcggccctgggctgcaagccaaagctacccgggaagcccagaagcgcacagctgccggaatcatgaaaaaccccaccgtggatggcattgttgccatcgacctcgatcccgtggtctatgacgcgaagttcgagaaacagctggggcagattatgctgctcatcctttgtacgtctcaaattctgctgatgagaacaacctgggctctctgcgaaagcatcacactggccaccggacctcttaccacactgtgggagggctccccgggcaagttttggaatacgaccatcgctgtgtctatggccaacattttccgggggagctacctcgccggagctggcctggccttctccctgatgaagagcctcgggggaggcagacgcgggacaggagcgcagggcgagacccttggcgaaaaatggaagcggcagctgaatcagctgtccaaatctgagtttaacacatataagagaagcgggatcatggaagtggaccgctccgaggccaaagaaggactcaagcggggcgagaccacgaagcacgctgtttctagagggacagccaaactgcgctggttcgtcgagcggaatcttgtgaagcccgaaggaaaagtgattgatctgggctgtgggagaggaggctggagctactattgcgctggcctcaagaaagtcaccgaggttaaggggtacaccaagggaggccctgggcacgaagagcccatccctatggccacatacggatggaacctggtgaaactgcattccggcaaggacgtgtttttcgtcccccctgaaaaatgtgataccctcctttgcgacattggggagtctagcccgaatcccacaatcgaggaaggacgcacgctgcgggtgctgaagatggttgagccttggctcagaggcaaccaattttgtattaaaatcctgaatccctatatgccttccgtggtcgaaacccttgagcagatgcagcgcaagcacggcgggatgctggtgcggaaccccctcagcagaaattctacacatgagatgtactgggtttcctgcggaaccggcaacatcgtgagcgcggtcaatatgacatctcgcatgctgctgaacagattcaccatggcccaccggaaaccgacgtatgaacgcgatgtggacctcggggctggaaccagacacgtggccgtcgagcctgaagttgctaacctggatattatcggccagcggattgagaatatcaagcatgaacacaagtccacatggcattacgacgaggataacccctataaaacctgggcctaccacgggagctatgaggtgaagccctctggatccgctagctccatggtgaatggcgtcgtgaaacttctgacaaagccttgggacgttattcccatggtgacccaaatcgccatgacagataccacgccttttggccagcagagagtcttcaaagaaaaggtggacacacggaccccgaaggcgaaacgcgggaccgcccaaatcatggaggttacagctaagtggctctggggatttctgagcagaaacaaaaagccccggatttgtacgcgcgaagagttcaccagaaaagtgcggtctaatgccgctatcggcgccgtctttgtggacgaaaaccagtggaatagcgccaaggaggcggttgaggatgaacgcttctgggaccttgtgcatagagagcgggaactgcacaagcaggggaaatgcgctacatgcgtctacaacatgatgggaaagcgcgagaaaaagctcggcgaatttgggaaagccaagggctccagagccatttggtacatgtggctgggagctcggttcctggagttcgaggccctcggctttatgaatgaagatcactggttctctcgcgagaacagcctgtccggggtggaaggagagggccttcataagctggggtatatcctcagagacatttctaaaatccctggaggcaatatgtacgctgatgacaccgccgggtgggatacacggatcaccgaggacgatctgcagaacgaagcgcgcattacagacatcatggagcccgaacacgcccttctggctaagagcatttttaaactcacctatcaaaataaggtcgtgagagttcagcggcctgccaaaaacggcacggtgatggatgtcatctccagacgcgaccagcggggatctggccaggtggggacctacggactgaatacattcaccaacatggaggctcaactgattagacagatggaaagcgagggcatcttttcccccagcgagctcgaaacaccgaacctggccgagcgcgtgcttgattggctggaaaagtatggggttgagcggctcaaaagaatggcgatctctggagacgactgtgtggtcaagcctattgatgaccgcttcgccaccgctctgacggcccttaatgatatgggcaaggtgcggaaagacatcccccagtgggaaccttccaaggggtggaacgattggcagcaagttcccttttgcagccatcacttccaccagctgattatgaaagacggcagagagatcgtggtcccttgtcgcaatcaggatgagctcgtgggacgggctagagtctctcagggcgccgggtggtccctgcgcgaaacagcttgcctgggaaagagctacgcccaaatgtggcagctcatgtattttcatcggagagacctgcggcttgcggccaacgctatttgttccgccgtgcccgttgattggatcccgacctctagaacaacctggagcattcacgcccatcaccagtggatgacgaccgaggacatgctgtccgtgtggaatcgcgtctggatcgaagagaacccttggatggaagataaaacacatatcagctcttggggcgacgtgccctacctcgggaagcgggaggaccaatggtgcggatccctgattggccttaccgctagagccacatgggcgaccaatatccaggttgctattaaccaggtgcgcagactgatcgggaatgagaactacctcgattatatgacaagcatgaagcggttcaaaaatgaatctgaccccgagggcgccctgtggtga

SEQ ID NO: 18581 - RNA, 9879 nt, synthetic construct
  misc_feature 1..9879: note = derived and/or modified CDS sequence (opt5) from DENV-1__HM181948__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagaccagcgccggcgttaacatgtgcacccttatcgcgatggacctgggggagctctgtgaagatacaatgacctacaaatgcccccgcatcacagaggtggaacccgacgatgtggactgttggtgcaatgctaccgatacgtgggtcacctatggaacatgttcccaaaccggcgagcacagacgggacaagcgctctgtggccctggcccctcatgttgggctgggactcgagacaagaaccgaaacgtggatgagctccgagggcgcttggaaacagattcagcgggtggaaacatgggccctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctattctgcgcaaactttgcatcgaagccaagatttccaataccacgacagatagcagatgtccgacccaaggagaggcgaccctggtggaagaacaagacgccaacttcgtgtgccggcgcacatttgtcgatagaggctggggcaatgggtgtggactcttcggcaaagggtctctgattacctgcgctaagtttaagtgcgtgacaaaacttgagggaaagatcgttcagtacgaaaacctgaaatattccgtgattgtcacggtgcacaccggcgaccagcatcaagttgggaatgagagcacagaacacggaaccacagccaccatcacgccccaggctcctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaatccagacatccggaaccacaaccatttttgccggccatctcaaatgcagactgaagatggataaacttacgctgaaggggatgagctatgtgatgtgtacaggctctttcaaactcgagaaggaagtcgctgagacccagcacggaaccgtgctggttcagatcaagtacgagggcacagacgccccgtgcaaaatccctttctccacccaagatgaaaagggggtgacacagaacggacggctgattacggcgaatcccatcgtcaccgacaaagagaagcctgtgaacattgaagctgagccgccctttggcgagagctatatcgtgattggggccggagaaaaagcccttaagctctcttggttcaagaaaggcagctccatcgggaagatgtttgaggctacagccagaggcgctcgccggatggccatcctgggagataccgcgtgggacttcggctctattgggggagtttttacaagcgtcggcaaactggtgcatcagatcttcgggaccgcctacggagtgctcttttccggcgtcagctggacgatgaagattgggatcggcgtgctgcttacctggctgggactcaattctagatccacaagcctgtctatgacctgtattgctgttggcctggtgacactttacctcggggtcatggtgcaggccgattccggatgcgttatcaactggaaaggccgcgaactgaagtgtgggagcggaattttcgtgaccaatgaggtccacacatggaccgaacaatataagtttcaggctgactcccctaaacggctgtctgccgcgatcggcaaggcctgggaggagggggtgtgcggcatcagaagcgctacgcgcctcgaaaacattatgtggaaacagatctccaacgagctgaatcatattcttctggaaaacgacatgaagttcacagttgtggtcggagatgtggccggcatcctcgctcaggggaaaaagatgattcggccgcaacccatggagtacaaatattcttggaaaagctggggaaaggccaagatcatcggcgccgacgtgcagaataccacctttattatcgatgggcctaacacacccgaatgtcctgacgatcagagagcttggaatatttgggaggtcgaggactacggattcggcatctttaccacgaacatttggctgaagctgcgcgattcctatacacaggtttgcgaccaccggcttatgagcgcggccatcaaagattctaaggctgtgcacgccgacatgggctactggatcgaatccgagaaaaatgaaacctggaagctcgccagagctagcttcattgaggtgaagacatgtatctggcccaaatctcataccctgtggtccaacggggtcctggaaagcgagatgattatcccgaagatttatggaggccctatctctcaacacaattaccgccccgggtacttcacacagaccgccggaccttggcatctcggcaaactggagcttgattttgacctgtgcgaagggacgaccgtggttgtggatgagcactgcggaaaccggggccccagcctcagaacaaccacagtcaccggcaagatcattcacgaatggtgttgccggtcctgtacgctgcctcccctgcgcttcagaggggaggacggatgctggtatggcatggagatccggccggtgaaagaaaaggaggaaaatcttgttaagagcatggtgtctgcggggtccggagaggtcgacagcttttccctcggcctgctgtgtatttctatcatgattgaagaggtgatgagaagccgctggtcccggaaaatgctcatgacagggaccctggctgttttccttctgctcatcatgggacagctgacatggaacgatctgattagactttgcatcatggtgggcgccaatgcctctgaccgcatgggcatggggaccacctacctggctctcatggccacatttaagatgagacctatgttcgcggtcggactgctctttcggcgcctgacgagcagagaggtgcttctgctcaccatcggcctgtccctggtggcttctgtcgaacttcccaacagcctggaggaactcggggatggactggccatgggcattatgatcctcaaactgcttacagacttccaatcccatcagctgtgggccaccctcctgagcctgacatttattaagaccacgttctctcttcactatgcttggaaaacaatggccatggttctgtccatcgtgagcctctttcccctgtgtctctctaccacctcccagaagacaacctggctgcctgtgcttctggggagcctgggatgcaagccgctcacaatgttcctgattgctgagaataaaatctggggccggcgctcttggccccttaacgaaggcatcatggccgtcgggattgtgtccatcctgctcagctccctgctcaagaacgatgttcctctggcgggaccccttattgccggcgggatgctgatcgcttgttacgtgattagcggatctagcgccgacctgtccctcgagaaagctgccgaggtctcttgggaagaggaagccgagcatagcggcgcttcccacaatatcctggtggaagttcaggatgacgggacgatgaagatcaaagatgaggagagagacgatacccttacaattctgctcaaggcgaccctgctcgccgtgtctggagtctatcctctgagcatccccgctacactttttgtgtggtacttctggcagaagaagaagcagcggtccggcgtcctgtgggacaccccttctcccccggaagtggagcgcgccgttctggatgacggcatttatagaatcatgcagcgggggctcctgggacgcagccaggtgggcgtcggggtgttccaagaaaacgtttttcatacgatgtggcacgtgaccagaggagccgtccttatgtaccagggcaaacggctggagccttcctgggctagcgtgaagaaagacctcatttcttacgggggaggctggagactgcagggctcctggaatacaggggaggaagtgcaggttatcgccgtcgagcccggaaagaaccctaaaaatgtgcaaaccgcgcccggcacattcaagaccccggaaggggaggtgggagctattgccctcgattttaagcctggcacaagcgggtctcccatcgtcaaccgcgaaggaaaaatcgtgggcctgtatggcaatggggttgtgacgacctccggaacatacgtcagcgccattgctcaggccaaggcgtcccaggagggccctcttcccgagatcgaagacgaggtgttccggaaaagaaacctgaccattatggatctgcaccccgggtctggaaagacccgccggtatctccctgctatcgttagagaagccattaaacgcaagctgcggacacttatcctggccccgacgagagtggtcgctagcgagatggccgaagctctcaagggcatgcccatccgctaccaaaccacagccgtgaaatccgagcataccgggaaggagattgttgacctgatgtgccacgcgacatttaccatgcggctgctcagccctgtgagagtccccaattataacatgatcattatggatgaagcccatttcacggacccttcttccatcgctgcccggggctacattagcacacgcgtgggaatgggcgaggctgccgccatctttatgaccgctacaccccctgggtctgtggaagcgttcccgcagagcaatgccgtcatccaggatgaggaaagagacattcccgagcggtcctggaactctggatatgagtggatcacagattttcctggcaaaaccgtttggttcgtgcccagcattaagtccgggaatgacatcgctaactgtcttcgcaaaaatggaaagagagtgattcagctgtctcggaagacatttgataccgaataccagaaaacgaagaacaacgactgggactacgtcgtgacaaccgatatcagcgagatgggcgccaatttcagagccgaccgcgttattgatcctcggagatgcctgaaacccgtgatcctcaaggacgggccggaacgcgtcatcctggctggccctatgcccgtgacagttgcctccgcggctcagcggagaggacgcattggccggaaccacaataaagagggggatcagtatatctacatgggacagccccttaacaatgacgaggatcatgcccactggaccgaagccaagatgctgctcgacaacattaatacgcctgagggcatcattcccgctctgttcgaacctgagagagaaaagagcgccgcgatcgatggggagtatcgcctgagaggagaggcccggaaaacctttgtggaactcatgcgcagaggcgaccttccggtctggctgtcttacaaggtggcttccgaggggttccaatatagcgatcggcgctggtgctttgacggcgaaagaaacaatcaggtcctggaggaaaacatggatgtggagatctggacaaaagagggagaacggaagaaactcagaccccgctggctggacgcccggacctactccgaccctcttgctctgagagagttcaaggaatttgccgctggccgccggtctgttagcggggatctcattctggagatcggaaaactgccccagcacctcacacagagagcccaaaatgcgcttgacaacctggtgatgctgcataattccgaacagggcgggcgggcctatcgccacgctatggaggagctccctgataccattgaaacactgatgcttctggccctcatcgctgtgctgaccggaggcgtcacgctgttctttctctctggcagagggcttggaaagacaagcattggcctgctgtgtgttatggcctccagcgtgctcctgtggatggcctctgtggagccccattggatcgctgcgtccatcattcttgagttctttctgatggtcctcctgatcccggagcctgaccggcagcgcacaccccaagataaccaactggcctacgtggttattgggctccttttcatgatcctgaccgtggctgccaatgagatgggactgctcgaaaccaccaagaaagacctgggcattgggcacgtcgccgtgggaaaccaccatcacgctgccatgcttgatgtcgacctgcatcctgcgagcgcctggacactctacgctgtggccacgaccatcattacacccatgatgagacacaccatcgagaacacaaccgctaatatctctctgacggccattgcgaaccaggccgctatcctgatgggcctcgataagggctggcctatttccaaaatggacatcggggttccccttctggccctgggatgctatagccaggtgaatccgctcaccctgacagctgccgtccttatgctggtggctcattacgccattatcggccctgggctccaagcgaaggccacccgggaagctcagaaacgcacagccgctggaatcatgaagaaccccaccgttgatggcattgtggccatcgacctggatcccgtcgtgtatgacgccaagtttgagaaacagctggggcagattatgctccttatcctgtgtacgtctcaaattctgctcatgagaacaacctgggcgctgtgcgaaagcatcacacttgctaccggacctctgaccacactctgggagggctccccgggcaagttctggaatacgaccatcgccgtgtctatggctaacatttttcgggggagctacctggccggagccggcctggctttctccctcatgaaaagccttgggggaggccgcagagggacaggagcccagggcgagaccctgggcgaaaagtggaaacggcagctgaatcagctctccaagtctgagttcaacacatataagagaagcgggatcatggaagttgaccgctccgaggcgaaagaaggactgaagcggggcgagaccacgaaacacgccgtctctagagggacagctaaacttcgctggtttgtggagcggaatctggtgaaacccgaaggaaaggtcattgatctcggctgtgggagaggaggctggagctactattgcgccggcctgaagaaagttaccgaggtgaaggggtacaccaaaggaggccctgggcacgaagaacccatccctatggctacatacggatggaacctggtgaagctccattccggcaaagacgtcttctttattccccctgaaaagtgtgatacccttctgtgcgacatcggggagtctagcccgaatcccacaattgaggaaggacgcacgctgcgggtgctcaaaatggttgagccttggctgagaggcaaccaattctgtatcaagatccttaatccctatatgccttccgtggtcgaaaccctggagcagatgcagcgcaagcacggcgggatgctcgtgcggaaccccctgagcagaaattctacacatgagatgtactgggtttcctgcggaaccggcaacattgtgagcgccgtcaatatgacatctcgcatgctgctcaaccggtttaccatggcgcacagaaaaccgacgtatgaacgcgatgtggacctgggggccggaaccagacacgtggctgtcgagcctgaagttgccaaccttgatatcattggccagcggatcgagaatattaagcatgaacacaaatccacatggcattacgacgaggataacccctataagacctgggcttaccacgggagctatgaggtgaaaccctctggatccgccagctccatggtgaatggcgtcgtgaagctgctcacaaagccttgggacgttatccccatggtgacccaaatcgctatgacagataccacgcctttcggccagcagcgcgtctttaaagaaaaggtggacacaagaaccccgaaagccaagcgggggaccgcgcaaattatggaggttacagccaaatggctgtggggattccttagcagaaacaagaagccccggatctgtacgcgcgaagagtttaccagaaaagtgcggtctaatgctgccattggcgctgtcttcgtggacgaaaaccagtggaatagcgccaaggaggccgttgaggatgaacgcttttgggacctggtgcatagagagcgggaactccacaaacaggggaagtgcgcgacatgcgtctacaacatgatgggaaaacgcgagaagaagctgggcgagttcgggaaagctaagggctccagagccatctggtacatgtggctgggagcccggtttctcgagttcgaggctctgggcttcatgaatgaagatcactggttttctcgcgagaacagcctttccggggtggaaggagagggcctgcataaactcgggtatattctgagagacatctctaagatccctggaggcaatatgtacgccgatgacaccgctgggtgggatacacggattaccgaggacgatcttcagaacgaagcccgcatcacagacattatggagcccgaacacgcgctgctcgccaaaagcatcttcaagctgacctatcaaaataaagtcgtgagagttcagcggcctgctaagaacggcacggtgatggatgtcatttcccgcagagaccagcggggatctggccaggtggggacctacggactgaatacatttaccaacatggaggcccaactcatcagacagatggaaagcgagggcatcttctcccccagcgagctggaaacaccgaaccttgctgagcgcgtgctggattggctcgaaaagtatggggttgagcggctgaaaagaatggccatttctggagacgactgtgtggtcaagcctatcgatgaccgctttgcgaccgcccttacggctctgaatgatatgggcaaagtgcggaaggacattccccagtgggaaccttccaaagggtggaacgattggcagcaagttcccttctgcagccatcactttcaccagctcatcatgaaggacggcagagagattgtggtcccttgtcgcaatcaggatgagctggtgggacgggccagagtctctcagggcgctgggtggtccctgcgcgaaacagcctgcctcggaaagagctacgctcaaatgtggcagctgatgtatttccatcggagagaccttcgcctggccgcgaacgccatctgttccgctgtgcccgttgattggattccgacctctcggacaacctggagcatccacgcccatcaccagtggatgacgaccgaggacatgctctccgtgtggaatagagtctggatcgaagagaacccttggatggaagataaaacacatattagctcttggggcgacgtgccctacctggggaagcgggaggaccaatggtgcggatcccttatcggcctgaccgccagagctacatgggccaccaatattcaggttgcgatcaaccaggtgcgccggctcattgggaatgagaactacctggattatatgacaagcatgaaaagatttaagaatgaatctgaccccgagggcgctctgtggtga

SEQ ID NO: 18582 - RNA, 9879 nt, synthetic construct
  misc_feature 1..9879: note = derived and/or modified CDS sequence (opt5) from DENV-1__HM181949__SS-prME
  source 1..9879: mol_type = other RNA
agcgtgaccatgctgctcatgctgatgcccaccgcccttgctttccacctgacgaccagaggaggggagcctcatatgatcgtgtccaagcaggaacggggaaaatctctcctgtttaagaccagcgccggagttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacaggacacggcaccacagctaccatcacgccccaggcccctaccacagaaattcagctcaccgactacggcgccctgacactggattgttctccccggaccgggctcgacttcaacgagatggttctgcttacgatgaaggaaaaatcctggctggtgcataagcagtggtttctcgatctgcctcttccctggacaagcggagcttccacctctcaagagacatggaatcgccaggacctgctcgtcaccttcaaaaccgcgcacgccaagaagcaggaggtggtcgtgctgggcagccaagaaggggctatgcacacagccctgacgggagccaccgagatccagacatccggcaccacaaccatttttgctgggcatctcaaatgcagactgaagatggataaacttacgctgaagggcatgagctatgttatgtgtacaggatctttcaaactcgaaaaggaggtggccgaaacccagcacggcaccgtcctggtgcagatcaagtacgaggggacagacgcgccgtgcaaaatccctttctccacccaagatgagaagggagttacacagaacggccggctgattacggctaatcccatcgtgaccgacaaagaaaagcctgtcaacattgaggccgaaccgccctttggggagagctatatcgtgattggagccggcgagaaagctcttaagctctcttggttcaagaaagggagctccatcggcaagatgtttgaagccacagctagaggagcccgccggatggcgatcctgggcgataccgcctgggacttcgggtctattggaggcgtgtttacaagcgttgggaaactggtccatcagatcttcggaaccgcttacggcgtgctcttttccggggtgagctggacgatgaagattggcatcggagtcctgcttacctggctgggcctcaattctagatccacaagcctgtctatgacctgtattgccgtggggctggttacactttacctcggagtgatggtccaggctgattccggctgcgtgatcaactggaaagggcgcgagctgaagtgtggaagcggcattttcgttaccaatgaagtgcacacatggaccgagcaatataagtttcaggccgactcccctaaacggctgtctgcggccatcgggaaggcttgggaagagggcgtctgcggaatcagaagcgccacgcgcctcgagaacattatgtggaaacagatctccaacgaactgaatcatattcttctggagaacgacatgaagttcacagtggttgtgggcgatgtcgctgggatcctcgcccagggcaagaagatgattcggccgcaacccatggaatacaaatattcttggaaaagctggggcaaggccaaaatcatcggggctgacgtgcagaataccacctttattatcgatggacctaacacacccgagtgtcctgacgatcagagagcgtggaatatttgggaagtggaggactacggcttcggcatctttaccacgaacatttggctgaagctgcgcgattcctatacacaggtctgcgaccaccggcttatgagcgccgctatcaaagattctaaggccgttcacgccgacatggggtactggatcgagtccgaaaagaatgagacctggaagctcgctagagccagcttcattgaagtgaagacatgtatctggcccaaatctcataccctgtggtccaacggagtgctggagagcgaaatgattatcccgaagatttatggcgggcctatctctcaacacaattaccgccccggatacttcacacagaccgcgggcccttggcatctcgggaaactggagcttgattttgacctgtgcgagggaacgaccgtcgtggttgatgaacactgcggcaaccggggccccagcctcagaacaaccacagtgaccgggaagatcattcacgagtggtgttgccggtcctgtacgctgcctcccctgcgcttcagaggagaagacggctgctggtatgggatggagatccggccggtcaaagagaaggaagagaatcttgtcaagagcatggtttctgctggatccggcgaagtggacagcttttccctcgggctgctgtgtatttctatcatgattgaggaagtcatgagaagccgctggtcccggaaaatgctcatgacaggaaccctggccgtgttccttctgctcatcatgggccagctgacatggaacgatctgattagactttgcatcatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggagcttcccaacagcctggaagaactcggagatggcctggccatggggattatgatcctcaaactgcttacagacttccaatcccatcagctgtgggctaccctcctgagcctgacatttattaagaccacgttctctcttcactatgcctggaaaacaatggctatggtcctgtccatcgttagcctctttcccctgtgtctctctaccacctcccagaagacaacctggctgcctgtgcttctgggaagcctgggctgcaagccgctcacaatgttcctgattgccgaaaataaaatctggggccggcgctcttggccccttaacgaggggatcatggcggtgggaattgtctccatcctgctcagctccctgctcaagaacgatgtgcctctggccggcccccttattgctgggggaatgctgatcgcctgttacgttattagcggctctagcgctgacctgtccctcgaaaaagccgccgaggtgtcttgggaggaagaggctgaacatagcggggcgtcccacaatatcctggtcgaggtgcaggatgacggaacgatgaagatcaaagatgaagagagagacgatacccttacaattctgctcaaggccaccctgctcgctgtttctggcgtgtatcctctgagcatccccgccacactttttgtctggtacttctggcagaaaaagaagcagcggtccggcgtgctgtgggacaccccttctcccccggaggtcgaacgcgccgtgctggatgacgggatttatagaatcatgcagcggggactcctgggccgcagccaggttggggtgggagtcttccaagagaacgtgtttcatacgatgtggcacgttaccagaggcgctgtgcttatgtaccaggggaaacggctggaaccttcctgggccagcgtcaagaaagacctcatttcttacggaggcggctggagactgcaggggtcctggaatacaggagaggaggtgcaagtgatcgcggttgaacccggcaagaaccctaaaaatgtccaaaccgctcccgggacattcaagaccccggagggagaagtgggcgccattgccctcgattttaagcctgggacaagcggatctcccatcgtgaaccgcgagggcaaaatcgtcggcctgtatgggaatggagtggttacgacctccggcacatacgtgagcgctattgcccaggcgaaggcttcccaggaagggcctcttcccgagatcgaggacgaagtcttccggaaaagaaacctgaccattatggatctgcaccccggatctggcaagacccgccggtatctccctgccatcgtgagagaggccattaaacgcaagctgcggacacttatcctggctccgacgagagttgtggccagcgaaatggctgaggccctcaaggggatgcccatccgctaccaaaccacagcggtcaaatccgaacataccggcaaggagattgtggacctgatgtgccacgccacatttaccatgcggctgctcagccctgttagagtgcccaattataacatgatcattatggatgaggctcatttcacggacccttcttccatcgccgctcggggatacattagcacacgcgtcggcatgggggaagccgccgctatctttatgaccgcgacaccccctggatctgtggaggccttcccgcagagcaatgctgtgatccaggatgaagagagagacattcccgaacggtcctggaactctggctatgagtggatcacagattttcctgggaaaaccgtctggttcgttcccagcattaagtccggaaatgacatcgccaactgtcttcgcaaaaatggcaagagagtgattcagctgtctcggaagacatttgataccgagtaccagaaaacgaagaacaacgactgggactacgtggtcacaaccgatatcagcgaaatgggggccaatttcagagctgaccgcgtgattgatcctcggagatgcctgaaacccgttatcctcaaggacggcccggagcgcgtgatcctggccggacctatgcccgtcacagtggcgtccgctgcccagcggagaggccgcattgggcggaaccacaataaagaaggagatcagtatatctacatgggccagccccttaacaatgacgaggatcatgcccactggaccgaggctaagatgctgctcgacaacattaatacgcctgaagggatcattcccgccctgttcgagcctgaaagagaaaagagcgcggccatcgatggagaatatcgcctgagaggcgaggctcggaaaacctttgttgagctcatgcgcagaggggaccttccggtgtggctgtcttacaaggtcgcctccgaaggcttccaatatagcgatcggcgctggtgctttgacggagagagaaacaatcaggtgctggaagagaacatggatgtcgaaatctggacaaaagagggcgagcggaagaaactcagaccccgctggctggacgctcggacctactccgaccctcttgccctgagagagttcaaggagtttgctgccgggcgccggtctgtgagcggagatctcattctggaaatcggcaaactgccccagcacctcacacagagagcgcaaaatgcccttgacaacctggttatgctgcataattccgagcaagggggacgggcttatcgccacgccatggaggaactccctgataccattgagacactgatgcttctggctctcatcgccgtgctgaccggcggcgtgacgctgttctttctctctgggagaggacttggcaagacaagcattgggctgctgtgtgtcatggcctccagcgttctcctgtggatggcttctgtggaaccccattggatcgcggcctccatcattcttgagttctttctgatggtgctcctgatcccggaacctgaccggcagcgcacaccccaggataaccaactggcttacgtcgtgattggactccttttcatgatcctgaccgttgccgccaatgagatgggcctgctcgagacaaccaagaaagacctggggattggacacgtggctgtcggcaaccaccatcacgccgcgatgcttgatgtggacctgcatcctgccagcgcttggacactctacgccgtcgctacgaccatcattacacccatgatgagacacaccatcgaaaacacaaccgccaatatctctctgacggcgattgccaaccaggctgccatcctgatgggcctcgataaggggtggcctatttccaaaatggacatcggagtgccccttctggctctgggctgctatagccaggttaatccgctcaccctgacagccgctgtgcttatgctggtcgcccattacgcgattatcgggcctggactccaagccaaggctacccgggaggcccagaaacgcacagctgccggcatcatgaagaaccccaccgtggatgggattgttgccatcgacctggatcccgtggtctatgacgcgaagtttgaaaaacagctgggacagattatgctccttatcctgtgtacgtctcaaattctgctcatgagaacaacctgggctctgtgcgagagcatcacacttgccaccggccctctgaccacactctgggaaggctccccggggaagttctggaatacgaccatcgctgtgtctatggccaacatttttcggggaagctacctggccggcgctgggctggccttctccctcatgaaaagccttggacgcggcagacgggggacaggagcgcagggcgagaccctgggcgagaagtggaaaagacagctgaatcagctctccaagtctgagttcaacacatataagcgcagcgggatcatggaggtggaccggtccgaagccaaagagggactgaagagaggcgaaaccacgaaacacgctgtttctcgcgggacagccaaacttcggtggtttgtcgagagaaatctggtgaaacccgagggaaaggtgattgatctcggctgtgggcgcggaggctggagctactattgcgctggcctgaagaaagtcaccgaagttaaggggtacaccaaaggaggccctgggcacgaggaacccatccctatggccacatacggatggaacctggtgaagctccattccggcaaagacgtgttctttattccccctgagaagtgtgatacccttctgtgcgacatcggggaatctagcccgaatcccacaattgaggagggacggacgctgagagtcctcaaaatggtggaaccttggctgcgcggcaaccaattctgtatcaagatccttaatccctatatgccttccgttgtggagaccctggaacagatgcagcggaagcacggcgggatgctcgtcagaaaccccctgagccgcaattctacacatgagatgtactgggtgtcctgcggaaccggcaacattgttagcgcggtgaatatgacatctcggatgctgctcaacagatttaccatggcccaccgcaaaccgacgtatgagagagatgtcgacctgggggctggaacccggcacgtggccgtggaacctgaggtcgctaaccttgatatcattggccagcgcatcgaaaatattaagcatgagcacaaatccacatggcattacgacgaagataacccctataagacctgggcctaccacgggagctatgaggttaaaccctctggatccgctagctccatggtgaatggcgtggtcaagctgctcacaaagccttgggacgtgatccccatggttacccaaatcgccatgacagataccacgcctttcggccagcagagagtgtttaaagagaaggtcgacacacggaccccgaaagcgaagagagggaccgcccaaattatggaagtgacagctaaatggctgtggggattccttagccggaacaagaagccccgcatctgtacgagagaggaatttacccggaaagttcgctctaatgccgctattggcgccgtgttcgtcgacgagaaccagtggaatagcgccaaggaagcggtggaggatgagagattttgggacctggttcatcgggaacgcgagctccacaaacaggggaagtgcgctacatgcgtgtacaacatgatgggaaaaagagaaaagaagctgggcgagttcgggaaagccaagggctcccgggccatctggtacatgtggctgggagctcgctttctcgagttcgaggccctgggcttcatgaatgaggatcactggttttctagagaaaacagcctttccggggtcgagggagaaggcctgcataaactcgggtatattctgcgggacatctctaagatccctggaggcaatatgtacgctgatgacaccgccgggtgggatacacgcattaccgaggacgatcttcagaacgaggcgagaatcacagacattatggaacccgagcacgccctgctcgctaaaagcatcttcaagctgacctatcaaaataaagtggtccgggtgcagcgccctgccaagaacggcacggttatggatgtgatttccagacgggaccagagaggatctggccaggtcgggacctacggactgaatacatttaccaacatggaagctcaactcatccgccagatggagagcgaaggcatcttctcccccagcgagctggagacaccgaaccttgccgaacgggtgctggattggctcgagaagtatggggtggaaagactgaaacgcatggcgatttctggagacgactgtgttgtgaagcctatcgatgaccggtttgccaccgctcttacggccctgaatgatatgggcaaagtcagaaaggacattccccagtgggagccttccaaagggtggaacgattggcagcaagtgcccttctgcagccatcactttcaccagctcatcatgaaggacggccgcgaaattgttgtgccttgtcggaatcaggatgagctggtcggcagagctcgcgtgtctcagggcgccgggtggtccctgcgggagacagcttgcctcggaaagagctacgcccaaatgtggcagctgatgtatttccatagacgcgaccttcggctggcggccaacgctatctgttccgccgtccccgtggattggattccgacctctagaacaacctggagcatccacgcccatcaccagtggatgacgaccgaagacatgctctccgtttggaatcgggtgtggatcgaggaaaacccttggatggaggataaaacacatattagctcttggggcgacgtcccctacctggggaagagagaagaccaatggtgcggatcccttatcggcctgaccgctcgcgccacatgggcgaccaatattcaggtggctatcaaccaggttcggagactcattgggaatgagaactacctggattatatgacaagcatgaaacgctttaagaatgagtctgaccccgaaggcgccctgtggtga

SEQ ID NO: 18583 - RNA, 9879 nt, synthetic construct
  misc_feature 1..9879: note = derived and/or modified CDS sequence (opt5) from DENV-1__HM181950__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttatcgccatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcggggctgcctacggagtgctcttttccggcgtgagctggaccatgaagattgggatcggcgtcctgcttacgtggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacagaacaatataagtttcaggcggactcccctaaacggctgtctgccgctatcggcaaggcctgggaggagggggtctgcggcatcagaagcgctacccgcctcgaaaacattatgtggaaacagatctccaacgagctgaatcatattcttctggaaaacgacatgaagttcacggtggttgtgggagatgtcgccggcatcctcgcccaggggaaaaagatgattcggccgcaacccatggagtacaaatattcttggaaaagctggggaaaggctaagatcatcggcgcggacgtgcagaatacaacctttattatcgatgggcctaacacccccgaatgtcctgacgatcagagagcctggaatatttgggaggtggaggactacggattcggcatctttacaaccaacatttggctgaagctgcgcgattcctatacgcaggtctgcgaccaccggcttatgagcgctgccatcaaagattctaaggccgttcacgctgacatgggctactggatcgaatccgagaaaaatgaaacatggaagctcgccagagcgagcttcattgaggtgaagacctgtatctggcccaaatctcatacactgtggtccaacggggtgctggaaagcgagatgattatcccgaagatttatggaggccctatctctcaacacaattaccgccccgggtacttcacccagacagctggaccttggcatctcggcaaactggagcttgattttgacctgtgcgaagggaccacggtcgtggttgatgagcactgcggaaaccggggccccagcctcagaaccacaaccgtgacaggcaagatcattcacgaatggtgttgccggtcctgtaccctgcctcccctgcgcttcagaggggaggacggatgctggtatggcatggagatccggccggtcaaagaaaaggaggaaaatcttgtcaagagcatggtttctgccgggtccggagaggtggacagcttttccctcggcctgctgtgtatttctatcatgattgaagaggtcatgagaagccgctggtcccggaaaatgctcatgacggggacactggccgtgttccttctgctcatcatgggacagctgacctggaacgatctgattagactttgcatcatggttggcgctaatgcctctgaccgcatgggcatggggacaacctacctggcgctcatggctacctttaagatgagacctatgttcgccgtgggactgctctttcggcgcctgacaagcagagaggtccttctgctcacgatcggcctgtccctggtggcctctgtggaacttcccaacagcctggaggaactcggggatggactggctatgggcattatgatcctcaaactgcttaccgacttccaatcccatcagctgtgggccacactcctgagcctgacctttattaagacaaccttctctcttcactatgcttggaaaacgatggccatggtcctgtccatcgttagcctctttcccctgtgtctctctacaacctcccagaagaccacatggctgcctgtgcttctggggagcctgggatgcaagccgctcaccatgttcctgattgcggagaataaaatctggggccggcgctcttggccccttaacgaaggcatcatggccgtggggattgtctccatcctgctcagctccctgctcaagaacgatgtgcctctggctggaccccttattgccggcgggatgctgatcgcttgttacgttattagcggatctagcgccgacctgtccctcgagaaagccgctgaggtgtcttgggaagaggaagcggagcatagcggcgcctcccacaatatcctggtcgaagtgcaggatgacgggacaatgaagatcaaagatgaggagagagacgatacgcttaccattctgctcaaggctacactgctcgccgtttctggagtgtatcctctgagcatccccgccaccctttttgtctggtacttctggcagaagaagaagcagcggtccggcgtgctgtgggacacaccttctcccccggaagtcgagcgcgctgtgctggatgacggcatttatagaatcatgcagcgggggctcctgggacgcagccaggttggcgtgggggtcttccaagaaaacgtgtttcataccatgtggcacgttacgagaggagccgtgcttatgtaccagggcaaacggctggagccttcctgggcgagcgtcaagaaagacctcatttcttacgggggaggctggagactgcagggctcctggaataccggggaggaagtgcaagtgatcgctgttgagcccggaaagaaccctaaaaatgtccaaacagcccccggcaccttcaagacaccggaaggggaggtgggagccattgctctcgattttaagcctggcaccagcgggtctcccatcgtgaaccgcgaaggaaaaatcgtcggcctgtatggcaatggggtggttacaacgtccggaacctacgtgagcgccattgcgcaggctaaggcctcccaggagggccctcttcccgagatcgaagacgaggtcttccggaaaagaaacctgacaattatggatctgcaccccgggtctggaaagacccgccggtatctccctgccatcgtgagagaagctattaaacgcaagctgcggacccttatcctggccccgacaagagttgtggctagcgagatggccgaagcgctcaagggcatgcccatccgctaccaaacgaccgccgtcaaatccgagcatacagggaaggagattgtggacctgatgtgccacgctacctttacaatgcggctgctcagccctgttagagtgcccaattataacatgatcattatggatgaagcccatttcaccgacccttcttccatcgctgcccggggctacattagcacgcgcgtcggaatgggcgaggccgctgcgatctttatgacagccacaccccctgggtctgtggaggctttcccgcagagcaatgccgtgatccaggatgaggaaagagacattcccgagcggtcctggaactctggatatgagtggatcaccgattttcctggcaaaacagtctggttcgttcccagcattaagtccgggaatgacatcgccaactgtcttcgcaaaaatggaaagagagtgattcagctgtctcggaagacctttgatacagaataccagaaaaccaagaacaacgactgggactacgtggtcacgacagatatcagcgagatgggcgctaatttcagagccgaccgcgtgattgatcctcggagatgcctgaaacccgttatcctcaaggacgggccggaacgcgtgatcctggcgggccctatgcccgtcaccgtggcttccgccgcccagcggagaggacgcattggccggaaccacaataaagagggggatcagtatatctacatgggacagccccttaacaatgacgaggatcatgctcactggacagaagccaagatgctgctcgacaacattaatacccctgagggcatcattcccgcgctgttcgaacctgagagagaaaagagcgccgctatcgatggggagtatcgcctgagaggagaggcccggaaaacgtttgttgaactcatgcgcagaggcgaccttccggtgtggctgtcttacaaggtcgcttccgaggggttccaatatagcgatcggcgctggtgctttgacggcgaaagaaacaatcaggtgctggaggaaaacatggatgtcgagatctggaccaaagagggagaacggaagaaactcagaccccgctggctggacgcccggacatactccgaccctcttgctctgagagagttcaaggaatttgccgcgggccgccggtctgtgagcggggatctcattctggagatcggaaaactgccccagcacctcacccagagagcccaaaatgctcttgacaacctggttatgctgcataattccgaacagggcgggcgggcctatcgccacgctatggaggagctccctgatacaattgaaaccctgatgcttctggccctcatcgccgtgctgacaggaggcgtgaccctgttctttctctctggcagagggcttggaaagacgagcattggcctgctgtgtgtcatggcttccagcgttctcctgtggatggcgtctgtggagccccattggatcgccgcttccatcattcttgagttctttctgatggtgctcctgatcccggagcctgaccggcagcgcacaccccaggataaccaactggcctacgtcgtgattgggctccttttcatgatcctgaccgttgccgctaatgagatgggactgctcgaaaccacaaagaaagacctgggcattgggcacgtggccgtcggaaaccaccatcacgcggccatgcttgatgtggacctgcatcctgctagcgcctggaccctctacgctgtcgccacaacgatcattacccccatgatgagacacacaatcgagaacaccacagcgaatatctctctgaccgccattgctaaccaggccgctatcctgatgggcctcgataagggctggcctatttccaaaatggacatcggggtgccccttctggccctgggatgctatagccaggttaatccgctcacgctgaccgctgccgtgcttatgctggtcgcgcattacgccattatcggccctgggctccaagctaaggccacacgggaagctcagaaacgcaccgccgccggaatcatgaagaaccccacagtggatggcattgttgcgatcgacctggatcccgtggtctatgacgctaagtttgagaaacagctggggcagattatgctccttatcctgtgtacctctcaaattctgctcatgagaacgacatgggccctgtgcgaaagcatcacccttgctacaggacctctgaccaccctctgggagggctccccgggcaagttctggaatacaacgatcgccgtgtctatggccaacatttttcgggggagctacctggctggagccggcctggcgttctccctcatgaaaagccttgggggaggccgcagagggaccggagcccagggcgagacactgggcgaaaagtggaaacggcagctgaatcagctctccaagtctgagttcaacacctataagagaagcgggatcatggaagtggaccgctccgaggctaaagaaggactgaagcggggcgagacaaccaaacacgccgtttctagagggacggctaaacttcgctggtttgtcgagcggaatctggtgaaacccgaaggaaaggtgattgatctcggctgtgggagaggaggctggagctactattgcgccggcctgaagaaagtcacagaggttaaggggtacaccaaaggaggccctgggcacgaagaacccatccctatggcgacctacggatggaacctggtgaagctccattccggcaaagacgtgttctttattccccctgaaaagtgtgatacacttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaacgctggagcagatgcagcgcaagcacggcgggatgctcgtccggaaccccctgagcagaaattctacccatgagatgtactgggtgtcctgcggaacaggcaacattgttagcgccgtgaatatgacctctcgcatgctgctcaaccggtttacaatggctcacagaaaaccgacctatgaacgcgatgtcgacctgggggccggaacgagacacgtggctgtggagcctgaagtcgccaaccttgatatcattggccagcggatcgagaatattaagcatgaacacaaatccacctggcattacgacgaggataacccctataagacatgggcttaccacgggagctatgaggttaaaccctctggatccgccagctccatggtgaatggcgtggtcaagctgctcaccaagccttgggacgtgatccccatggttacacaaatcgcgatgaccgatacaacccctttcggccagcagcgcgtgtttaaagaaaaggtcgacacgagaacaccgaaagccaagcgggggaccgctcaaattatggaggtgaccgccaaatggctgtggggattccttagcagaaacaagaagccccggatctgtacacgcgaagagtttacgagaaaagttcggtctaatgctgccattggcgccgtgttcgtcgacgaaaaccagtggaatagcgcgaaggaggctgtggaggatgaacgcttttgggacctggttcatagagagcgggaactccacaaacaggggaagtgcgcgacctgcgtgtacaacatgatgggaaaacgcgagaagaagctgggcgagttcgggaaagccaagggctccagagctatctggtacatgtggctgggagcccggtttctcgagttcgaggctctgggcttcatgaatgaagatcactggttttctcgcgagaacagcctttccggggtcgaaggagagggcctgcataaactcgggtatattctgagagacatctctaagatccctggaggcaatatgtacgccgatgacacagcggggtgggatacccggattacagaggacgatcttcagaacgaagcccgcatcaccgacattatggagcccgaacacgctctgctcgccaaaagcatcttcaagctgacatatcaaaataaagtggtcagagtgcagcggcctgctaagaacggcaccgttatggatgtgatttcccgcagagaccagcggggatctggccaggtcgggacgtacagcctgaatacctttacaaacatggaggcccaactcatcagacagatggaatccgagggaatcttcagcccctctgagctggaaaccccgaaccttgcggagcgcgtgctggattggctcgaaaagtatggcgtggagcggctgaaaagaatggccatttccggggacgactgtgttgtgaagcctatcgatgaccgctttgctacagcccttaccgctctgaatgatatgggaaaagtccggaaggacattccccagtgggaacctagcaaaggctggaacgattggcagcaagtgcccttctgctctcatcactttcaccagctcatcatgaaggacgggagagagattgttgtgccttgtcgcaatcaggatgagctggtcggccgggccagagtgtcccagggagctggctggagcctgcgcgaaacggcctgcctcgggaagtcctacgcgcaaatgtggcagctgatgtatttccatcggagagaccttcgcctggccgctaacgccatctgttctgccgtccccgtggattggattccgacaagccggaccacatggtccatccacgctcatcaccagtggatgaccacggaggacatgctcagcgtttggaatagagtgtggatcgaagagaacccttggatggaagataaaacccatatttcttcctggggagacgtcccctacctgggcaagcgggaggaccaatggtgcgggagccttatcggactgacagccagagcgacctgggctacaaatattcaggtggccatcaaccaggttcgccggctcattggcaatgagaactacctggattatatgacctctatgaaaagatttaagaatgaaagcgaccccgagggggccctgtggtga

SEQ ID NO: 18584 - RNA, 9879 nt, synthetic construct
  misc_feature 1..9879: note = derived and/or modified CDS sequence (opt5) from DENV-1__HM181952__SS-prME
  source 1..9879: mol_type = other RNA
agcgtgaccatgctgctcatgctgatgcccaccgcccttgctttccacctgacgaccagaggcggggagcctcatatgatcgtctccaagcaggaacggggaaagtctctcctgtttaagacgagcgccggcgttaacatgtgcacccttattgcgatggacctgggggagctctgtgaagatacaatgacctacaagtgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgactccggatgcgttatcaactggaaaggccgcgagctgaagtgtgggagcggaattttcgtgaccaatgaagtccacacatggaccgagcaatataagtttcaggccgattcccctaaacggctctctgcggccatcggcaaggcttgggaggaaggggtgtgcggcattagaagcgccacgcgcctggagaacatcatgtggaaacagatctccaacgaacttaatcatattctgctcgagaacgacatgaagttcacagttgtggtcggagacgtggctggcatcctggtgcaggggaaaaagatgattcggccgcaacccatggaatacaaatattcttggaaaagctggggaaaggccaaaatcattggcgccgatgtccaaaattccacctttatcatcgacgggcctaacacccccgagtgtcctgatgaccagagagcttggaatatttgggaggttgaagattacggattcggcatctttacaaccaacatttggctgaaacttcgcgacagctatacacaggtgtgcgatcaccggctcatgtctgcggccatcaaagactccaaggctgtgcacgccgatatgggctactggattgagagcgagaagaatgagacatggaagctggccaaggcttctttcatcgaagtcaaaacctgtatctggcccaagtcccatacactgtggagcaacggggtgctcgagtctgagatgattatcccgaaaattcacggaggccctatcagccaacataattatagacccgggtacttcacccagacagccggaccttggcacctgggcaaacttgaactggactttgatctctgcgaggggaccacggttgtggtcgacgaacactgcggaaaccgcggcccctccctgcggaccacaaccgtgacaggcaaaattatccatgagtggtgttgcagaagctgtaccctgcctccccttcggttccgcggggaggatggatgctggtacggcatggaaatcagaccggttaaggagaaggaagagaatctcgtgaaatctatggtctccgcggggagcggagaagtggactccttttctctgggcctgctctgtattagcatcatgattgaggaggttatgcggtccagatggtctcgcaagatgctgatgacggggacacttgctgtgttctttctgctcatcatgggacagctgacctggaacgacctgattcggctttgcatcatggtcggcgccaatgccagcgatagaatgggcatggggacaacctatctggctctcatggccaccttcaaaatgcgccctatgtttgcggtgggactgctgttcagacggctgacatcccgcgaagtgcttctgctcacgattggcctgtctctggtcgctagcgttgagcttcccaactccctggaagaactcggggacggactggccatgggcatcatgatcctcaagctgcttaccgattttcaaagctaccagctgtgggccacactcctgtctctgaccttcattaaaacaaccttttcccttcactatgcttggaagacgatggccatggtgctgagcatcgtgtctctcttccccctgtgtctctccacaaccagccagaagaccacatggctgcctgtccttctggggtctctgggatgcaaaccgctcaccatgtttctgattgctgaaaataagatctggggcagaaaatcctggccccttaacgagggcattatggccgtggggatcgttagcatcctgctctccagcctgctcaagaacgacgtgcctctggcgggaccccttattgccggcgggatgctgatcgcttgttacgtcatttctggaagctccgccgatctgtctctcgagaaagctgccgaagtgagctgggaggaagaggccgaacattccggcgcttctcacaatatcctggttgaggtgcaggacgatgggacaatgaagattaaagacgaggaacgggatgacacgcttaccatcctgctcaaggcgacactgctcgccgtcagcggagtgtatcctctgtccatccccgctacccttttcgtctggcatttctggcaaaagaaaaagcagcgctctggcgtgctgtgggatacacctagccctcccgaggttgaaagagccgtgctggacgatggcatttaccggatcatgcagcgcgggctcctgggaagatcccaggtcggcgtgggggtttttcaagagaacgtgttccacaccatgtggcacgtcacgcggggagccgtgcttatgtatcagggcaaacgcctggagcccagctgggcttctgtgaagaaagacctcatttcctacgggggaggctggagactgcagggcagctggaataccggggaagaggttcaggtcatcgccgtggaacccggaaagaaccctaagaatgtgcaaacagcgcccggcacctttaaaacaccggagggggaagtcggagctattgccctcgacttcaagcctggcacctctgggtcccccatcgtgaaccgggagggaaaaattgttggcctgtacggcaatggggtggtcacaacgagcggaacctatgtgtccgccatcgctcaggccaaggcgtctcaggagggccctcttcccgaaatcgaggatgaagtttttagaaaacgcaacctgacaattatggacctgcatcccgggagcggaaagacccggagatacctccctgctatcgtgcgcgaggccattaagcggaaactgagaacccttatcctggccccgacacgcgtcgtggcttccgaaatggccgaggctctcaagggcatgcccattcggtatcaaacgaccgccgttaaaagcgagcacacagggaaggaaatcgtggatctgatgtgccatgcgaccttcacaatgagactgctctctcctgtccgcgtgcccaattacaacatgatcattatggacgaggcccactttaccgatccttccagcatcgctgcccggggctatatttctacgagagtgggaatgggcgaagctgccgccatcttcatgacagctacaccccctgggagcatggaggcgtttccgcagtccaatgccgtcattcaggacgaagaacgggatatccccgagcgctcttggaacagcggatacgaatggatcaccgacttccctggcaaaacagtttggtttgtgccctccattaaggctgggaatgatatcgccaactgtcttagaaagaatggaaaacgggtgattcagctgtctcgcaagaccttcgacacagagtatcagaagaccaagaacaacgattgggactacgtcgtgacgacagacatcagcgaaatgggcgccaatttcagagctgatcgggttattgaccctagacgctgcctgaaacccgtgatcctcaaggatgggccggagcgggtcattctggccggccctatgcccgtgaccgttgcgtccgctgcccagagacgcggacggatcggcagaaaccataataaggagggggaccagtacatctatatgggacagccccttaacaatgatgaagaccacgcccactggacagaggctaaaatgctgctcgataacattaatacccctgaaggcatcattcccgccctgtttgagcctgaacgcgaaaagagcgcggccatcgacggggagtaccggctgagaggagaagctcgcaaaacgttcgtggagctcatgagacggggcgatcttccggtctggctgtcttataaggtggcctccgaagggtttcaatacagcgaccgcagatggtgcttcgatggcgagcggaacaatcaggtcctggaagagaacatggacgtggagatttggaccaaagaaggagagcgcaagaaactcagaccccggtggctggatgctagaacatattccgaccctcttgccctgcgcgaatttaaggagttcgctgccggccggagatctgttagcggggacctcatcctggaaatcggaaagctgccccagcatctcacccagcgcgcgcaaaatgcccttgataacctggtgatgctgcacaattccgagcagggcgggcgggcttacagacatgccatggaggaactccctgacacaattgagaccctgatgcttctggctctcatcgccgtgctgacaggaggcgtcaccctgtttttcctctctggcaaagggcttggaaagacgagcattggcctgctgtgtgttatggcctccagcgtgctcctgtggatggcttctgtggaaccccactggatcgcggcctccattatccttgagtttttcctgatggtcctcctgatcccggagcctgatcggcagcgcacaccccaggacaaccaactggcttatgtggttattgggctcctttttatgatcctgaccgtggccgccaatgaaatgggactgctcgagaccaccaagaaggatctgggcattgggcacgtcgctgtggaaaaccatcaccatgccgcgatgcttgacgtcgatctgcaccctgccagcgcttggaccctctacgccgtggctacaacgatcattacccccatgatgagacatacaatcgagaacaccacagccaatatttctctgaccgcgatcgccaaccaggctgccatcctgatgggactcgacaaaggctggcctatttccaagatggatatcggcgttccccttctggctctggggtgctacagccaggtgaatccgctcacgctgaccgccgctgtccttatgctggtggcccactatgcgattgttggacctggcctccaagccaaggctacacgggaagcccagaaacgcaccgctgccgggatcatgaagaaccccacaattgacggaatcgtggccatcgatctggaccccgtcgtgtacgatgcgaaattcgagaagcagctgggccagattatgctccttatcctgtgtacctctcaaattctgctcatgagaacgacatgggctctgtgcgagagcatcacccttgccacagggcctctgaccaccctctgggaaggatccccgggcaaattttggaatacaacgattgctgtgtctatggccaacatcttccggggcagctatctggccggggctggactggccttctccctcatgaaaagccttggcgggggacgcagaggcaccggggcgcagggagagacactgggcgaaaagtggaaacggcagctgaatcagctctccaagtctgagtttaacacctacaaacgcagcggcatcatggaagttgacagatccgaggccaaggaggggctgaaacggggagaaacaaccaagcacgctgtctctagaggcacggccaaacttcgctggttcgtggagcggaatctggtgaaacccgaagggaaggtcattgacctcggatgtggcagagggggatggagctattactgcgctggcctgaaaaaggttacagaggtgaaaggctataccaaagggggacctggccatgaggagcccatccctatggccacctacgggtggaacctggtgaaactccactccggaaaggatgtctttttcattccccctgagaagtgtgacacacttctgtgcgatatcggcgaatctagcccgaatcccaccattgaggaagggcgcacactgcgggtgctcaaaatggttgagccttggctgagaggaaaccaattttgtatcaagattcttaatccctacatgccttccgtggtcgagacgctggaacagatgcagcgcaaacatggcggcatgctcgtgcggaaccccctgagcagaaattctacccacgagatgtattgggtttcctgcgggacaggaaacatcgtgagcgcggtcaatatgacctctcgcatgctgctcaaccggttcacaatggcccacagaaagccgacctacgaacgcgacgtggatctgggcgctgggacgcggcatgtggccgtcgagcctgaagttgctaaccttgacatcattggacagagaatcgagaatattaaacacgagcataagtccacctggcactatgatgaagacaacccctacaagacatgggcctatcatggcagctacgaggtgaaaccctctgggtccgctagctccatggtgaatggagtcgtgaagctgctcaccaaaccttgggatgttatccccatggtgacacaaattgccatgaccgacacaaccccttttggccagcagcgcgtcttcaaggaaaaagtggatacgagaacaccgaaggcgaagcggggcaccgcccaaatcatggaggttaccgctcgctggctgtgggggtttcttagcagaaacaaaaagccccggatctgtacaagagaagagttcacgcggaaagtgcgctctaatgccgctattggagccgtctttgtggacgagaaccagtggaatagcgccaaggaagcggttgaggacgatagattctgggacctggtgcaccgggaacgcgagctccacaaacagggcaagtgcgctacctgcgtctataacatgatggggaagagagagaagaagctgggagagtttggcaaagccaaggggtcccgggccatctggtacatgtggctgggcgctcgcttcctcgagttcgaagccctgggatttatgaatgaggatcattggttctctagagaaaacagcctttccggcgtggagggggagggactgcacaaactcggctacattctgcgggacatctctaagattcctgggggaaatatgtatgctgatgacacagccggctgggatacccgcatcacagaagacgatcttcagaacgaggcgaaaatcaccgacattatggaacccgagcatgccctgctcgctaagagcatctttaagctgacataccaaaataaagtcgtgagagttcagcggcctgccaagaacgggaccgtgatggatgtcatttcccgcagagaccagcggggctctggacaggtgggcacgtatgggctgaataccttcacaaacatggaagctcaactcatccgccagatggagagcgagggaatttttctgcccaacgaacttgagaccccgaatctggccgaaagagtgctcgattggctggagaaatacggcgttgaacggcttaagagaatggcgatctccggggacgactgtgtggtcaaacctatcgatgaccgcttcgccacagctctgaccgccctcaacgatatgggaaaggtgcggaaggacattccccagtgggagcctagcaaaggctggaatgattggcagcaagttcccttttgctctcaccacttccatcagctgatcatgaaggacgggagagagattgtggtcccttgtcgcaaccaggatgaactggtgggccgggctagagtctcccagggagccggctggagcctccgcgagacggcttgcctggggaaatcttatgcccaaatgtggcagcttatgtactttcaccggagagacctgcgcctcgcggccaatgctatctgttccgccgtgcccgttgattgggtgccgacaagccggaccacatggtccattcatgcccaccatcagtggatgaccacggaagacatgctgtctgtctggaacagagtgtggatcgaggaaaatccttggatggaggataagacccgcattagctcctgggaggacgttccctatcttggaaaacgggaagaccaatggtgcggcagcctgatcgggctcacagctagagccacctgggcgacaaacatccaggtggctattaatcaggtccggagactgatcggaaacgagaattactctgattacatgacctccatgaagcgcttcaagaacgaaagcgagcccgagggcgccctgtggtga

SEQ ID NO: 18585 - RNA, 9879 nt, synthetic construct
  misc_feature 1..9879: note = derived and/or modified CDS sequence (opt5) from DENV-1__HM181953__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagaccagcgccggcgttaatatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaagacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgtgcaggggaaaaagatgattcggccgcaacccatggagtacaaatattcttggaaaagctggggaaaggccaagatcatcggcgccgacgtgcagaataccacctttattatcgatgggcctaacacacccgaatgtcctgacgatcagagagcttggaatatttgggaggtcgaggactacggattcggcatctttaccacgaacatttggctgaagctgcgcgattcctatacacaggtttgcgaccaccggcttatgagcgcggccatcaaagattctaaggctgtgcacgccgacatgggctactggatcgaatccgagaaaaatgaaacctggaagctcgccagagctagcttcattgaggtgaagacatgtatctggcccaaatctcataccctgtggtccaacggggtcctggaaagcgagatgattatcccgaagatttatggaggccctatctctcaacacaattaccgccccgggtacttcacacagaccgccggaccttggcatctcggcaaactggagcttgattttgacctgtgcgaagggacgaccgtggttgtggatgagcactgcggaaaccggggccccagcctcagaacaaccacagtcaccggcaagatcattcacgaatggtgttgccggtcctgtacgctgcctcccctgcgcttcagaggggaggacggatgctggtatggcatggagatccggccggtgaaagaaaaggaggaaaatcttgttaagagcatggtgtctgcggggtccggagaggtcgacagcttttccctcggcctgctgtgtatttctatcatgattgaagaggtgatgagaagccgctggtcccggaaaatgctcatgacagggaccctggctgttttccttctgctcatcatgggacagctgacatggaacgatctgattagactttgcatcatggtgggcgccaatgcctctgaccgcatgggcatggggaccacctacctggctctcatggccacatttaagatgagacctatgttcgcggtcggactgctctttcggcgcctgacgagcagagaggtgcttctgctcaccatcggcctgtccctggtggcttctgtcgaacttcccaacagcctggaggaactcggggatggactggccatgggcattatgatcctcaaactgcttacagacttccaatcccatcagctgtgggccaccctcctgagcctgacatttattaagaccacgttctctcttcactatgcttggaaaacaatggccatggttctgtccatcgtgagcctctttcccctgtgtctctctaccacctcccagaagacaacctggctgcctgtgcttctggggagcctgggatgcaagccgctcacaatgttcctgattgctgagaataaaatctggggccggcgctcttggccccttaacgaaggcatcatggccgtcgggattgtgtccatcctgctcagctccctgctcaagaacgatgttcctctggcgggaccccttattgccggcgggatgctgatcgcttgttacgtgattagcggatctagcgccgacctgtccctcgagaaagctgccgaggtctcttgggaagaggaagccgagcatagcggcgcttcccacaatatcctggtggaagttcaggatgacgggacgatgaagatcaaagatgaggagagagacgatacccttacaattctgctcaaggcgaccctgctcgccgtgtctggagtctatcctctgagcatccccgctacactttttgtgtggtacttctggcagaagaagaagcagcggtccggcgtcctgtgggacaccccttctcccccggaagtggagcgcgccgttctggatgacggcatttatagaatcatgcagcgggggctcctgggacgcagccaggtgggcgtcggggtgttccaagaaaacgtttttcatacgatgtggcacgtgaccagaggagccgtccttatgtaccagggcaaacggctggagccttcctgggctagcgtgaagaaagacctcatttcttacgggggaggctggagactgcagggctcctggaatacaggggaggaagtgcaggttatcgccgtcgagcccggaaagaaccctaaaaatgtgcaaaccgcgcccggcacattcaagaccccggaaggggaggtgggagctattgccctcgattttaagcctggcacaagcgggtctcccatcgtcaaccgcgaaggaaaaatcgtgggcctgtatggcaatggggttgtgacgacctccggaacatacgtcagcgccattgctcaggccaaggcgtcccaggagggccctcttcccgagatcgaagacgaggtgttccggaaaagaaacctgaccattatggatctgcaccccgggtctggaaagacccgccggtatctccctgctatcgttagagaagccattaaacgcaagctgcggacacttatcctggccccgacgagagtggtcgctagcgagatggccgaagctctcaagggcatgcccatccgctaccaaaccacagccgtgaaatccgagcataccgggaaggagattgttgacctgatgtgccacgcgacatttaccatgcggctgctcagccctgtgagagtccccaattataacatgatcattatggatgaagcccatttcacggacccttcttccatcgctgcccggggctacattagcacacgcgtgggaatgggcgaggctgccgccatctttatgaccgctacaccccctgggtctgtggaagcgttcccgcagagcaatgccgtcatccaggatgaggaaagagacattcccgagcggtcctggaactctggatatgagtggatcacagattttcctggcaaaaccgtttggttcgtgcccagcattaagtccgggaatgacatcgctaactgtcttcgcaaaaatggaaagagagtgattcagctgtctcggaagacatttgataccgaataccagaaaacgaagaacaacgactgggactacgtcgtgacaaccgatatcagcgagatgggcgccaatttcagagccgaccgcgttattgatcctcggagatgcctgaaacccgtgatcctcaaggacgggccggaacgcgtcatcctggctggccctatgcccgtgacagttgcctccgcggctcagcggagaggacgcattggccggaaccacaataaagagggggatcagtatatctacatgggacagccccttaacaatgacgaggatcatgcccactggaccgaagccaagatgctgctcgacaacattaatacgcctgagggcatcattcccgctctgttcgaacctgagagagaaaagagcgccgcgatcgatggggagtatcgcctgagaggagaggcccggaaaacctttgtggaactcatgcgcagaggcgaccttccggtctggctgtcttacaaggtggcttccgaggggttccaatatagcgatcggcgctggtgctttgacggcgaaagaaacaatcaggtcctggaggaaaacatggatgtggagatctggacaaaagagggagaacggaagaaactcagaccccgctggctggacgcccggacctactccgaccctcttgctctgagagagttcaaggaatttgccgctggccgccggtctgttagcggggatctcattctggagatcggaaaactgccccagcacctcacacagagagcccaaaatgcgcttgacaacctggtgatgctgcataattccgaacagggcgggcgggcctatcgccacgctatggaggagctccctgataccattgaaacactgatgcttctggccctcatcgctgtgctgaccggaggcgtcacgctgttctttctctctggcagagggcttggaaagacaagcattggcctgctgtgtgttatggcctccagcgtgctcctgtggatggcctctgtggagccccattggatcgctgcgtccatcattcttgagttctttctgatggtcctcctgatcccggagcctgaccggcagcgcacaccccaagataaccaactggcctacgtggttattgggctccttttcatgatcctgaccgtggctgccaatgagatgggactgctcgaaaccaccaagaaagacctgggcattgggcacgtcgccgtgggaaaccaccatcacgctgccatgcttgatgtcgacctgcatcctgcgagcgcctggacactctacgctgtggccacgaccatcattacacccatgatgagacacaccatcgagaacacaaccgctaatatctctctgacggccattgcgaaccaggccgctatcctgatgggcctcgataagggctggcctatttccaaaatggacatcggggttccccttctggccctgggatgctatagccaggtgaatccgctcaccctgacagctgccgtccttatgctggtggctcattacgccattatcggccctgggctccaagcgaaggccacccgggaagctcagaaacgcacagccgctggaatcatgaagaaccccaccgttgatggcattgtggccatcgacctggatcccgtcgtgtatgacgccaagtttgagaaacagctggggcagattatgctccttatcctgtgtacgtctcaaattctgctcatgagaacaacctgggcgctgtgcgaaagcatcacacttgctaccggacctctgaccacactctgggagggctccccgggcaagttctggaatacgaccatcgccgtgtctatggctaacatttttcgggggagctacctggccggagccggcctggctttctccctcatgaaaagccttgggggaggccgcagagggacaggagcccagggcgagaccctgggcgaaaagtggaaacggcagctgaatcagctctccaagctggagttcaacacatataagagatctgggatcatggaagttgaccgcagcgaggcgaaagaaggacttaagcggggcgagaccacgaaacacgccgtctccagagggacagctaagctgcgctggtttgtggagcggaatctcgtgaaacccgaaggaaaggtcattgatctgggctgtgggagaggaggctggtcttactattgcgccggcctgaagaaagttaccgaggtgaaggggtacaccaaaggaggccctgggcacgaagaacccatccctatggctacatacggatggaacctcgtgaaacttcatagcggcaaagacgtcttctttattccccctgaaaagtgtgataccctgctgtgcgacatcggggagtcctctccgaatcccacaattgaggaaggacgcacgctccgggtgctgaaaatggttgagccttggcttagaggcaaccaattctgtatcaagatcctgaatccctatatgcctagcgtggtcgaaaccctcgagcagatgcagcgcaagcacggcgggatgctggtgcggaaccccctgtccagaaatagcacacatgagatgtactgggtttcttgcggaaccggcaacattgtgtccgccgtcaatatgacaagccgcatgctcctgaaccggtttaccatggcgcacagaaaaccgacgtatgaacgcgatgtggaccttggggccggaaccagacacgtggctgtcgagcctgaagttgccaacctggatatcattggccagcggatcgagaatattaagcatgaacacaaatctacatggcattacgacgaggataacccctataagacctgggcttaccacgggtcctatgaggtgaaacccagcggatctgcctccagcatggtgaatggcgtcgtgaagctcctgacaaagccttgggacgttatccccatggtgacccaaatcgctatgacagataccacgcctttcggccagcagcgcgtctttaaagaaaaggtggacacaagaaccccgaaagccaagcgggggaccgcgcaaattatggaggttacagccaaatggctttggggattcctgtccagaaacaagaagccccggatctgtacgcgcgaagagtttaccagaaaagtgcggagcaatgctgccattggcgctgtcttcgtggacgaaaaccagtggaactctgccaaggaggccgttgaggatgaacgcttttgggacctcgtgcatagagagcgggaactgcacaaacaggggaagtgcgcgacatgcgtctacaacatgatgggaaaacgcgagaagaagctgggcgagttcgggaaagctaagggcagcagagccatctggtacatgtggctcggagcccggtttctggagttcgaggctcttggcttcatgaatgaagatcactggttttcccgcgagaactctctgagcggggtggaaggagagggcctccataaactggggtatattcttagagacatctccaagatccctggaggcaatatgtacgccgatgacaccgctgggtgggatacacggattaccgaggacgatctgcagaacgaagcccgcatcacagacattatggagcccgaacacgcgctcctggccaaatctatcttcaagctgacctatcaaaataaagtcgtgagagttcagcggcctgctaagaacggcacggtgatggatgtcattagccgcagagaccagcggggatccggccaggtggggacctacggactcaatacatttaccaacatggaggcccaactgatcagacagatggaatctgagggcatcttcagcccctccgagcttgaaacaccgaacctggctgagcgcgtgctcgattggctggaaaagtatggggttgagcggcttaaaagaatggccattagcggagacgactgtgtggtcaagcctatcgatgaccgctttgcgaccgccctgacggctctcaatgatatgggcaaagtgcggaaggacattccccagtgggaaccttctaaagggtggaacgattggcagcaagttcccttctgctcccatcactttcaccagctgatcatgaaggacggcagagagattgtggtcccttgtcgcaatcaggatgagctggtgggacgggccagagtcagccagggcgctgggtggtctctccgcgaaacagcctgcctgggaaagtcctacgctcaaatgtggcagcttatgtatttccatcggagagacctgcgcctcgccgcgaacgccatctgtagcgctgtgcccgttgattggattccgacctcccggacaacctggtctatccacgcccatcaccagtggatgacgaccgaggacatgctgagcgtgtggaatagagtctggatcgaagagaacccttggatggaagataaaacacatatttccagctggggcgacgtgccctaccttgggaagcgggaggaccaatggtgcggatctctgatcggcctcaccgccagagctacatgggccaccaatattcaggttgcgatcaaccaggtgcgccggctgattgggaatgagaactacctggattatatgacatccatgaaaagatttaagaatgaaagcgaccccgagggcgctctctggtga

SEQ ID NO: 18586 - RNA, 9879 nt, synthetic construct
  misc_feature 1..9879: note = derived and/or modified CDS sequence (opt5) from DENV-1__KF921933__SS-prME
  source 1..9879: mol_type = other RNA
agcgtgaccatgctgctcatgctgatgcccacagcccttgctttccacctgacgacccggggaggggaacctcatatgatcgtgtccaagcaggaacggggaaagtctctcctgtttaagacaagcgccggcgttaacatgtgcacccttatcgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcaaatgtccgacccaaggagaggccaccctggttgaagaacaggacgctaacttcgtgtgcagacggacatttgtggatcgcggctggggcaatgggtgtggactcttcggcaaggggtctctgattacctgcgccaagtttaaatgcgtcacaaaacttgagggaaaaatcgtgcagtacgaaaacctgaagtattccgttattgtgacggtccacaccggcgaccagcatcaagtggggaatgagagcacagaacacggaaccacagctaccatcacgccccaggcccctaccacagagattcagctcaccgactacggcgccctgacactggattgttctcccagaaccggcctcgacttcaacgaaatggttctgcttacgatgaaagagaagtcctggctggtgcataaacagtggtttctcgatctgcctcttccctggacaagcggggcttccacctctcaagagacatggaatcggcaggacctgctcgtcaccttcaagaccgcgcacgccaagaaacaggaagtggtcgtgctgggaagccaagagggcgctatgcacacagccctgacgggggccaccgaaatccagacatccggaaccacaaccatttttgctggccatctcaagtgccgcctgaaaatggataaacttacgctgaaagggatgagctatgttatgtgtacaggctctttcaagctcgagaaggaagtggccgagacccagcacggaaccgtcctggtgcagatcaaatacgagggcacagacgcgccgtgcaagatccctttctccacccaagatgaaaaaggggttacacagaacggaagactgattacggctaatcccatcgtgaccgacaaggagaaacctgtcaacattgaagccgagccgccctttggcgagagctatatcgtgattggggccggagaaaaggctcttaagctctcttggttcaaaaagggcagctccatcgggaaaatgtttgaggccacagctcggggcgccagacgcatggcgatcctgggagataccgcctgggacttcggctctattgggggagtgtttacaagcgttggcaagctggtccatcagatcttcgggaccgcttacggagtgctcttttccggcgtgagctggacgatgaaaattgggatcggcgtcctgcttacctggctgggactcaattctcggtccacaagcctgtctatgacctgtattgccgtgggcctggttacactttacctcggggtgatggtccaggctgattccggatgcgtgatcaactggaagggcagagaactgaagtgtgggagcggaattttcgttaccaatgaggtgcacacatggaccgaacaatataaatttcaggccgactcccctaagcgcctgtctgcggccatcggcaaggcttgggaggagggggtctgcggcatccggagcgccacgagactcgaaaacattatgtggaagcagatctccaacgagctgaatcatattcttctggaaaacgacatgaaattcacagtggttgtgggagatgtcgctggcatcctcgcccaggggaagaaaatgattcgcccgcaacccatggagtacaagtattcttggaaaagctggggaaaggccaagatcatcggcgctgacgtgcagaataccacctttattatcgatgggcctaacacacccgaatgtcctgacgatcagcgggcgtggaatatttgggaggtggaggactacggattcggcatctttaccacgaacatttggctgaaactgagagattcctatacacaggtctgcgaccaccgccttatgagcgccgctatcaaggattctaaagccgttcacgccgacatgggctactggatcgaatccgagaagaatgaaacctggaagctcgctcgggccagcttcattgaggtgaaaacatgtatctggcccaagtctcataccctgtggtccaacggggtgctggaaagcgagatgattatcccgaaaatttatggaggccctatctctcaacacaattacagactcgggtacttcacacagaccgcgggaccctggcatctgggcaaacttgagctggattttgacctctgcgaagggacgaccgtcgtggttgatgagcactgcggaaaccgcggccctagcctgcggacaaccacagtgaccggcaaaatcattcacgaatggtgttgcagatcctgtacgctgccccctcttcggttccgcggggaggacggatgctggtatggcatggagatcagacccgtcaaggaaaaggaggaaaatctcgtgaaaagcatggtttctgctgggtccggagaggtggacagcttttccctgggcctgctctgtatttctatcatgattgaagaggtcatgcggagcagatggtcccgcaagatgctgatgacagggacccttgccgtgttcctgctcctgatcatgggacagctgacatggaacgatcttattcggctgtgcatcatggttggcgccaatgcttctgacagaatgggcatggggaccacctacctcgccctgatggcgacatttaaaatgcgcccgatgttcgctgtgggactcctgtttagacggcttacgagccgcgaggtcctgctcctgaccatcggcctgtcccttgtggcctctgtggaactgcctaacagcctcgaggaactgggggatggactcgccatgggcattatgatcctgaaacttctgacagacttccaatcccatcagctctgggctaccctgctgagccttacatttattaaaaccacgttctctctgcactatgcctggaagacaatggctatggtcctctccatcgttagcctgtttcccctctgtctgtctaccacctcccagaagacaacctggcttcccgtgctgctggggagcctcggatgcaaacctctgacaatgttccttattgccgagaataagatctggggcagacggtcttggccgctgaacgaaggcatcatggcggtggggattgtctccatcctcctgagctccctcctgaaaaacgatgtgccccttgccggacctctgattgctggcgggatgctgatcgcctgttacgttattagcggatctagcgctgacctctccctggagaaggccgccgaggtgtcttgggaagaggaagctgagcatagcggcgcgtcccacaatatccttgtcgaagtgcaggatgacgggacgatgaaaatcaaggatgaggagcgcgacgataccctgacaattctcctgaaagccaccctcctggctgtttctggagtgtatccccttagcatccctgccacactgtttgtctggtacttctggcaaaagaagaaacagagatccggcgtgctgtgggacaccccctctcctcccgaagtcgagcgggccgtgctcgatgacggcatttatcgcatcatgcagagagggctgcttggacggagccaggttggcgtgggggtcttccaagaaaacgtgtttcatacgatgtggcacgttacccgcggagctgtgctgatgtaccagggcaagagactcgagccgtcctgggccagcgtcaaaaaggacctgatttcttacgggggaggctggcggctccagggctcctggaatacaggggaggaagtccaggtgatcgcggttgagcctggcaagaaccccaagaatgtccaaaccgctcctggcacattcaagacccccgaaggggaggtgggagccattgccctggattttaaaccgggcacaagcgggtctcctatcgtgaacagagaaggaaagatcgtcggcctttatggcaatggggtggttacgacctccggaacatacgtgagcgctattgcccaggcgaaggcttcccaggagggccccctgcctgagatcgaagacgaggtcttccgcaagcggaacctgaccattatggatctccaccccgggtctggaaaaaccagacgctatctgcccgccatcgtgcgggaagccattaagagaaaacttcgcacactgatcctcgctcctacgcgggttgtggccagcgagatggctgaagccctgaaaggcatgccgatcagataccaaaccacagcggtcaagtccgagcataccgggaaagagattgtggacctgatgtgccacgccacatttaccatgcgcctccttagccccgttcgggtgcctaattataacatgatcattatggatgaagctcatttcacggacccctcttccatcgccgctagaggctacattagcacacgggtcggaatgggcgaggccgccgctatctttatgaccgcgacccctcccgggtctgtggaagccttccctcagagcaatgctgtgatccaggatgaggaacgcgacattccggagagatcctggaactctggatatgagtggatcacagattttcccggcaagaccgtctggttcgttcctagcattaaatccgggaatgacatcgccaactgtctgcggaagaatggaaagcgcgtgattcagctgtctagaaaaacatttgataccgaataccaaaagacgaaaaacaacgactgggactacgtggtcacaaccgatatcagcgagatgggcgccaatttccgggctgacagagtgattgatccccgccggtgcctcaagcctgttatcctgaaagacgggcccgaaagagtgatccttgccggcccgatgcctgtcacagtggcgtccgctgcccagcgccggggaagaattggccgcaaccacaataaggagggggatcagtatatctacatgggacagcccctgaacaatgacgaggatcatgcccactggaccgaagctaagatgctcctggacaacattaatacgcccgagggcatcattcctgccctgttcgaacccgagcgggaaaagagcgcggccatcgatggggagtatagactccgcggagaggctagaaagacctttgttgagcttatgcggcgcggcgacctgcctgtgtggctgtcttacaaagtcgcctccgaggggttccaatatagcgatagacggtggtgctttgacggcgaacgcaacaatcaggtgctcgaggaaaacatggatgtcgagatctggacaaaggagggagaacgcaagaagctgcggccgagatggcttgacgctcgcacctactccgaccccctggccctccgggagttcaaagaatttgctgccggcagacgctctgtgagcggggatctgattctggagatcggaaagctccctcagcaccttacacagcgggcgcaaaatgccctggacaacctggttatgctccataattccgaacagggcgggagagcttatcggcacgccatggaggagctgcccgataccattgaaacacttatgctgctcgctctgatcgccgtgctgaccggaggcgtgacgctgttctttctttctggccgcgggctgggaaagacaagcattggcctgctctgtgtcatggcctccagcgttctgctttggatggcttctgtggagcctcattggatcgcggcctccatcattctggagttctttctcatggtgctgctgatccccgagccggacagacagcggacccctcaggataaccaactcgcttacgtcgtgattgggcttctgttcatgatcctgaccgttgccgccaatgagatgggactcctggaaacaaccaaaaaggaccttggcattgggcacgtggctgtcggaaaccaccatcacgccgcgatgctggatgtggacctccatcccgccagcgcttggacactgtacgccgtcgctacgaccatcattacacctatgatgcgccacaccatcgagaacacaaccgccaatatctctctgacggcgattgccaaccaggctgccatcctcatgggccttgataaaggctggcccatttccaagatggacatcggggtgcctctgctggctctcggatgctatagccaggttaatcccctgacccttacagccgctgtgctgatgctcgtcgcccattacgcgattatcggcccggggctgcaagccaaagctaccagagaagcccagaagcggacagctgccggaatcatgaagaaccctaccgtggatggcattgttgccatcgacctggatcccgtggtctatgacgcgaaatttgagaagcagctcgggcagattatgcttctgatcctgtgtacgtctcaaattctcctgatgcgcacaacctgggctctttgcgaaagcatcacactggccaccggacccctcaccacactgtgggagggctcccctggcaaattctggaatacgaccatcgctgtgtctatggccaacatttttagagggagctacctggccggagctggcctcgccttctcccttatgaaaagcctcgggggcgggcggcgcgggacaggagcgcagggcgagaccctgggcgaaaaatggaagagacagctcaatcagctgtccaagtctgagttcaacacatataaacggagcgggatcatggaagtggacagatccgaggccaaggaaggacttaaacgcggcgagaccacgaagcacgctgtttctcgggggacagccaaactgagatggtttgtcgagcgcaatctcgtgaagccggaaggaaaggtgattgatctgggctgtgggcggggaggctggagctactattgcgctggcctgaaaaaggtcaccgaggttaaagggtacaccaagggaggccccgggcacgaagaacctatccccatggccacatacggatggaacctcgtgaaacttcattccggcaaggacgtgttctttattcctcccgaaaaatgtgataccctgctgtgcgacatcggggagtctagccctaatccgacaattgaggaaggaagaacgctccgcgtcctgaagatggtggagccctggcttcggggcaaccaattctgtatcaagatcctgaatccttatatgccctccgttgtggaaaccctcgagcagatgcagagaaaacacggcgggatgctggtccgcaaccctctgagcagaaattctacacatgagatgtactgggtgtcctgcggaaccggcaacattgttagcgcggtgaatatgacatctagaatgctcctgaaccgctttaccatggcccaccggaagcccacgtatgaaagagatgtcgaccttggggctggaacccgccacgtggccgtggagccggaagtcgctaacctggatatcattggccagagaatcgagaatattaaacatgaacacaagtccacatggcattacgacgaggataacccttataaaacctgggcctaccacgggagctatgaggttaagccctctggatccgctagctccatggtgaatggcgtggtcaagctcctgacaaaaccctgggacgtgatccctatggttacccaaatcgccatgacagataccacgcccttcggccagcagcgggtgtttaaggaaaaagtcgacacacgcacccctaaggcgaaaagagggaccgcccaaattatggaggtgacagctaagtggctttggggattcctgagccggaacaagaaaccgagaatctgtacgcgggaagagtttacccgcaaggttagatctaatgccgctattggcgccgtgttcgtcgacgaaaaccagtggaatagcgccaaagaggcggtggaggatgggcggttttgggacctcgttcatcgcgaaagagagctgcacaagcagggaaaatgcgctacatgcgtgtacaacatgatgggcaagcgggaaaagaaactgggggagttcggcaaggccaaaggatcccgcgccatctggtacatgtggctcggcgctagatttctggagttcgaggcccttgggttcatgaatgaggatcactggttttctcgggaaaacagcctgtccggagtcgagggcgaagggctccataagctgggatatattcttcgcgacatctctaaaatccccggcgggaatatgtacgctgatgacaccgccggctgggatacaagaattaccgaggacgatctgcagaacgaggcgcggatcacagacattatggaacctgagcacgccctcctggctaagagcatcttcaaactgacctatcaaaataaggtggtccgcgtgcagagacccgccaagaacggaacggttatggatgtgatttcccggcgcgaccagagaggctctgggcaggtcggaacctacggcctcaatacatttaccaacatggaagctcaactgatccggcagatggagagcgaagggatcttctcccctagcgagcttgagacacccaacctggccgaaagagtgctcgattggctggagaaatatggagtggaacgccttaagcggatggcgatttctggcgacgactgtgttgtgaaaccgatcgatgacagatttgccaccgctctgacggccctcaatgatatggggaaggtccgcaaagacattcctcagtgggagccctccaagggctggaacgattggcagcaagtgcctttctgcagccatcactttcaccagctgatcatgaaggacggacgggaaattgttgtgccctgtagaaatcaggatgagctggtcggccgcgctcgggtgtctcagggggccggatggtccctcagagagacagcttgcctgggcaaaagctacgcccaaatgtggcagcttatgtatttccatcgccgggacctgagactcgcggccaacgctatctgttccgccgtccctgtggattggattcccacctctcgcacaacctggagcatccacgcccatcaccagtggatgacgaccgaagacatgctgtccgtttggaatcgggtgtggatcgaggaaaacccgtggatggaggataagacacatattagctcttggggagacgtcccttaccttggaaaaagagaagaccaatggtgcggctccctgatcgggctcaccgctcgggccacatgggcgaccaatattcaggtggctatcaaccaggttagacgcctgattggcaatgagaactacctggattatatgacaagcatgaagcggtttaaaaatgagtctgaccccgaaggagccctctggtga

SEQ ID NO: 18587 - RNA, 9879 nt, synthetic construct
  misc_feature 1..9879: note = derived and/or modified CDS sequence (opt5) from DENV-1__HM181954__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagagcaggacgctaacttcgtgtgccggcgcacatttgtggatagaggctggggcaatgggtgtggactcttcggcaaagggtctctgatcacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaccgggggctagcacctcccaagagacatggaatcgccaggacctgctcgtcaccttcaaaaccgcgcacgccaagaagcaggaagtggtcgtgctgggatctcaagagggcgctatgcacacagccctgacgggggccaccgaaatccagacaagcggaaccacaaccatttttgctggccatctcaaatgcagactgaagatggataaacttacgctgaaggggatgtcctatgttatgtgtacaggcagcttcaaactcgagaaggaagtggccgagacccagcacggaaccgtcctggtgcagatcaagtacgagggcacagacgcgccttgcaaaatccccttctctacccaagatgaaaagggggttacacagaacggacggctgattacggctaatcctatcgtgaccgacaaagagaagcccgtcaacattgaagccgagcccccttttggcgagtcctatatcgtgattggggccggagaaaaagctcttaagctcagctggttcaagaaaggctctagcatcgggaagatgtttgaggccacagctagaggcgcccgccggatggcgatcctgggagataccgcctgggacttcggctccattgggggagtgtttacatctgttggcaaactggtccatcagatcttcggggctgcctacggagtgctctttagcggcgtgtcctggaccatgaagattgggatcggcgtcctgcttacgtggctgggactcaatagcagatctacctccctgagcatgacatgtattgctgtgggcctggttaccctttacctcggggtgatggtccaggccgattctggatgcgtgatcaactggaaaggccgcgaactgaagtgtgggtccggaattttcgttacaaatgaggtgcacacctggacagaacaatataagtttcaggcggacagcccgaaacggctgtccgccgctatcggcaaggcctgggaggagggggtctgcggcatcagatctgctacccgcctcgaaaacattatgtggaaacagatcagcaacgagctgaatcatattcttctggaaaacgacatgaagttcacggtggttgtgggagatgtcgccggcatcctcgcccaggggaaaaagatgattcggccccaacctatggagtacaaatattcctggaagtcttggggaaaggctaaaatcatcggcgcggacgtgcagaatacaacctttattatcgatgggcccaacacccctgaatgtcccgacgatcagagagcctggaatatttgggaggtggaggactacggattcggcatctttacaaccaacatttggctgaagctgcgcgatagctatacgcaggcttgcgaccaccggcttatgtccgccgccatcaaagatagcaaggctgtccacgccgacatgggctactggatcgaatctgagaaaaatgaaacatggaagctcgcgagagcttccttcattgaggttaagacctgtatctggccgaaaagccatacactgtggtctaacggggtgctggaatccgagatgattatccctaagatttatggaggccccatcagccaacacaattaccgccctgggtacttcacccagacagccggaccctggcatctcggcaaactggagcttgattttgacctgtgcgaagggaccacggtggtcgtggatgagcactgcggaaaccggggcccttctctcagaaccacaaccgttacaggcaagatcattcacgaatggtgttgccggagctgtaccctgcccccgctgcgcttcagaggggaggacggatgctggtatggcatggagatccggcctgtgaaagaaaaggaggaaaatcttgtcaagtccatggtgagcgccgggtctggagaggttgactcctttagcctcggcctgctgtgtatttccatcatgattgaagaggtgatgagatctcgctggagccggaaaatgctcatgacggggacactggctgtcttccttctgctcatcatgggacagctgacctggaacgatctgattagactttgcatcatggtgggcgccaatgcgtccgaccgcatgggcatggggacaacctacctggctctcatggccacctttaagatgagacccatgttcgccgttggactgctctttcggcgcctgacatctagagaggtgcttctgctcacgatcggcctgagcctggtcgcttccgtggaacttcccaactctctggaggaactcggggatggactggccatgggcattatgatcctcaaactgcttaccgacttccaaagccatcagctgtgggctacactcctgtccctgacctttattaagacaaccttcagccttcactatgcctggaaaacgatggcgatggtgctgtctatcgtctccctctttcctctgtgtctcagcacaacctctcagaagaccacatggctgccggttcttctggggtccctgggatgcaagcccctcaccatgttcctgattgccgagaataaaatctggggccggcgcagctggcctcttaacgaaggcatcatggctgtggggattgtgtctatcctgctctccagcctgctcaagaacgatgtccccctggccggacctcttattgctggcgggatgctgatcgcctgttacgtgatttccggaagctctgccgacctgagcctcgagaaagctgcggaggtttcctgggaagaggaagccgagcattctggcgctagccacaatatcctggtggaagtccaggatgacgggacaatgaagatcaaagatgaggagagagacgatacgcttaccattctgctcaaggccacactgctcgccgtgtccggagtttatcccctgtctatccctgctaccctttttgtgtggtacttctggcaaaaaaagaagcagcggagcggcgtcctgtgggacacaccctccccgcctgaagtggagcgcgccgtcctggatgacggcatttatagaatcatgcagcgggggctcctgggacgctctcaggtgggcgttggggtgttccaagaaaacgtctttcataccatgtggcacgtgacgagaggagcggttcttatgtaccagggcaaacggctggagcccagctgggcttccgtgaagaaagacctcattagctacgggggaggctggagactgcagggctcttggaataccggggaggaagtccaggtgatcgccgtggagcctggaaagaaccccaaaaatgttcaaacagccccgggcaccttcaagacacctgaaggggaggtcggagctattgccctcgattttaagcccggcacctccgggagccctatcgtgaaccgcgaaggaaaaatcgtgggcctgtatggcaatggggtcgtgacaacgtctggaacctacgtttccgcgattgctcaggccaaggccagccaggagggcccccttcccgagatcgaagacgaggtgttccggaaaagaaacctgacaattatggatctgcaccctgggtccggaaagacccgccggtatctcccggctatcgtcagagaagccattaaacgcaagctgcggacccttatcctggctcccacaagagtggttgcctctgagatggcggaagccctcaagggcatgcctatccgctaccaaacgaccgctgtgaaaagcgagcatacagggaaggagattgtcgacctgatgtgccacgccacctttacaatgcggctgctctcccccgtgagagttcctaattataacatgatcattatggatgaagctcatttcaccgaccccagctctatcgccgcccggggctacatttccacgcgcgtgggaatgggcgaggctgcggccatctttatgacagctacccctccggggagcgtcgaagccttcccccagtctaatgccgtgatccaggatgaggaaagagacattcctgagcggagctggaactccggatatgagtggatcaccgattttcccggcaaaacagtgtggttcgtcccttctattaagagcgggaatgacatcgctaactgtcttcgcaaaaatggaaagagagttattcagctgtcccggaagacctttgatacagaataccaaaaaaccaagaacaacgactgggactacgtggtgacgacagatatctctgagatgggcgccaatttcagagcggaccgcgtcattgatccccggagatgcctgaaaccggtgatcctcaaggacgggcctgaacgcgttatcctggctggccccatgcccgtgaccgtcgccagcgccgctcagcggagaggacgcattggccggaaccacaataaagagggggatcagtatatctacatgggacagcctcttaacaatgacgaggatcatgcccactggacagaagcgaagatgctgctcgacaacattaatacccccgagggcatcattcctgccctgttcgaaccggagagagaaaagtccgctgccatcgatggggagtatcgcctgagaggagaggctcggaaaacgtttgtggaactcatgcgcagaggcgaccttcccgtttggctgagctacaaggtggcctctgaggggttccaatattccgatcggcgctggtgctttgacggcgaaagaaacaatcaggtcctggaggaaaacatggatgtggagatctggaccaaagagggagaacggaagaaactcagacctcgctggctggacgctcggacatacagcgacccccttgccctgagagagttcaaggaatttgcggccggccgccggtccgtctctggggatctcattctggagatcggaaaactgcctcagcacctcacccagagagctcaaaatgcccttgacaacctggtgatgctgcataatagcgaacagggcgggcgggcttatcgccacgccatggaggagctccccgatacaattgaaaccctgatgcttctggccctcatcgctgttctgacaggaggcgtgaccctgttctttctctccggcagagggcttggaaagacgtctattggcctgctgtgtgtgatggcgagctccgtcctcctgtggatggccagcgttgagccgcattggatcgctgcctctatcattcttgaattctttctgatggtgctcctgatccctgagcccgaccggcagcgcacacctcaggataaccaactggcctacgtggtcattgggctccttttcatgatcctgaccgtggctgccaatgagatgggactgctcgaaaccacaaagaaagacctgggcattgggcacgttgcggtgggaaaccaccatcacgccgctatgcttgatgtcgacctgcatcccgcctccgcttggaccctctacgccgtggcgacaacgatcattacccctatgatgagacacacaatcgagaacaccacagccaatatcagcctgaccgctattgccaaccaggctgccatcctgatgggcctcgataagggctggcccatttctaaaatggacatcggggtcccgcttctggctctgggatgctattcccaggtgaatcctctcacgctgaccgccgcggttcttatgctggtggcccattacgctattatcggccccgggctccaagccaaggctacacgggaagcccagaaacgcaccgccgcgggaatcatgaagaaccccacagtcgatggcattgtggctatcgacctggatcctgttgtgtatgacgccaagtttgagaaacagctggggcagattatgctccttatcctgtgtaccagccaaattctgctcatgagaacgacatgggctctgtgcgaatctatcacccttgccacaggaccgctgaccaccctctgggagggcagccccggcaagttctggaatacaacgatcgccgtctccatggctaacatttttcgggggtcttacctggccggagcgggcctggccttcagcctcatgaaatcccttgggggaggccgcagagggaccggagctcagggcgagacactgggcgaaaagtggaaacggcagctgaatcagctcagcaagtccgagttcaacacctataagagatctgggatcatggaagtggaccgcagcgaggccaaagaaggactgaagcggggcgagacaaccaaacacgctgtgtccagagggacggccaagcttcgctggtttgttgagcggaatctggtcaaacctgaaggaaaggtgattgatctcggctgtgggagaggaggctggtcttactattgcgcgggcctgaagaaagtgacagaggtcaaggggtacaccaaaggaggccccgggcacgaagagcctatccccatggccacctacggatggaacctggttaagctccatagcggcaaagacgtgttctttattcctccggaaaagtgtgatacacttctgtgcgacatcggggagtcctctcccaatcctaccattgaggaaggacgcacactgcgggtgctcaaaatggtcgagccctggctgagaggcaaccaattctgtatcaagatccttaatccttatatgcccagcgtggttgaaacgctggagcagatgcagcgcaagcacggcgggatgctcgtgcggaacccgctgtccagaaatagcacccatgagatgtactgggtctcttgcggaacaggcaacattgtgtccgctgttaatatgaccagccgcatgctgctcaaccggtttacaatggcccacagaaaacctacctatgaacgcgatgtggacctgggggctggaacgagacacgtcgccgtggagcccgaagtggctaaccttgatatcattggccagcggatcgagaatattaagcatgaacacaaatctacctggcattacgacgaggataacccctataagacatgggcctaccacgggtcctatgaggtcaaacctagcggatctgcgtccagcatggttaatggcgtggtgaagctgctcaccaagccctgggacgtcatccctatggtgacacaaatcgccatgaccgatacaaccccgttcggccagcagcgcgtttttaaagaaaaggtggacacgagaacacccaaagctaagcgggggaccgcccaaattatggaggtcaccgctaaatggctgtggggattcctttccagaaacaagaagcctcggatctgtacacgcgaagagtttacgagaaaagtgcggagcaatgccgccattggcgcggttttcgtggacgaaaaccagtggaattctgctaaggaggccgtcgaggatgaacgcttttgggacctggtgcatagagagcgggaactccacaaacaggggaagtgcgccacctgcgtttacaacatgatgggaaaacgcgagaagaagctgggcgaattcgggaaagctaagggcagcagagccatctggtacatgtggctgggagctcggtttctcgagttcgaggccctgggcttcatgaatgaagatcactggttttcccgcgagaactctcttagcggggtggaaggagagggcctgcataaactcgggtatattctgagagacatctccaagatccccggaggcaatatgtacgcggatgacacagccgggtgggatacccggattacagaggacgatcttcagaacgaagctcgcatcaccgacattatggagcctgaacacgccctgctcgctaaatctatcttcaagctgacatatcaaaataaagtcgtgagagtccagcggcccgccaagaacggcaccgtgatggatgttattagccgcagagaccagcggggatccggccaggtggggacgtacggactgaatacctttacaaacatggaggcgcaactcatcagacagatggaatctgagggcatcttcagcccgtccgagctggaaacccctaaccttgccgagcgcgtcctggattggctcgaaaagtatggggtggagcggctgaaaagaatggctattagcggagacgactgtgtggttaagcccatcgatgaccgctttgccacagctcttaccgccctgaatgatatgggcaaagtgcggaaggacattcctcagtgggaaccctctaaagggtggaacgattggcagcaagtccctttctgctcccatcactttcaccagctcatcatgaaggacggcagagagattgtggttccctgtcgcaatcaggatgagctggtgggacgggctagagtcagccagggcgccgggtggtctctgcgcgaaacggcgtgcctcggaaagtcctacgcccaaatgtggcagctgatgtatttccatcggagagaccttcgcctggctgccaacgccatctgtagcgctgtgccggtcgattggattcctacatcccggaccacatggtctatccacgcccatcaccagtggatgaccacggaggacatgctcagcgtgtggaatagagtttggatcgaagagaacccctggatggaagataaaacccatatttccagctggggcgacgtgccctacctggggaagcgggaggaccaatggtgcggatctcttatcggcctgacagcgagagctacctgggccacaaatattcaggtcgccatcaaccaggtgcgccggctcattgggaatgagaactacctggattatatgacctccatgaaaagatttaagaatgaaagcgaccctgagggcgctctgtggtga

SEQ ID NO: 18588 - RNA, 9879 nt, synthetic construct
  misc_feature 1..9879: note = derived and/or modified CDS sequence (opt5) from DENV-1__HM181955__SS-prME
  source 1..9879: mol_type = other RNA
agcgtgaccatgctgctcatgctgatgcccacagcccttgctttccacctgacgaccagaggcggggagcctcatatgatcgtctccaagcaggaacgggggaaatctctcctgtttaagaccagcgccggcgttaatatgtgcacccttatcgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagtctgcctggaaacagattcagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtggactcttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcagcacccaagatgaaaagggcgttacacagaacgggcggctgattacggctaatcccatcgtgaccgacaaagagaagcctgtcaacattgaagccgagccgccctttggagagtcttatatcgtgattggcgccggggaaaaagctcttaagctcagctggttcaagaaaggatcctctatcggcaagatgtttgaggccacagctagaggggcccgccggatggcgatcctgggcgataccgcctgggacttcggaagcattggcggggtgtttacatccgttggaaaactggtccatcagatcttcggcaccgcttacggggtgctctttagcggagtgtcttggacgatgaagattggcatcggggtcctgcttacctggctgggcctcaattccagaagcacatctctgtccatgacctgtattgccgtgggactggttacactttacctcggcgtgatggtccaggctgatagcgggtgcgtgatcaactggaaaggacgcgaactgaagtgtggctccgggattttcgttaccaatgaggtgcacacatggaccgaacaatataagtttcaggccgactctcctaaacggctgagcgcggccatcggaaaggcttgggaggagggcgtctgcgggatcagatccgccacgcgcctcgaaaacattatgtggaaacagatctctaacgagctgaatcatattcttctggaaaacgacatgaagttcacagtggttgtgggcgatgtcgctggaatcctcgcccagggcaaaaagatgattcggccgcaacccatggagtacaaatatagctggaagtcctgggggaaggccaaaatcatcggagctgacgtgcagaataccacctttattatcgatggccctaacacacccgaatgtcctgacgatcagagagcgtggaatatttgggaggtggaggactacgggttcggaatctttaccacgaacatttggctgaagctgcgcgatagctatacacaggtctgcgaccaccggcttatgtctgccgctatcaaagattccaaggccgttcacgccgacatgggctactggatcgaaagcgagaaaaatgaaacctggaagctcgctagagcctctttcattgaggtgaagacatgtatctggcccaaatcccataccctgtggagcaacggcgtgctggaatctgagatgattatcccgaagatttatgggggacctatcagccaacacaattaccgccccggctacttcacacagaccgcggggccttggcatctcggaaaactggagcttgattttgacctgtgcgaaggcacgaccgtcgtggttgatgagcactgcgggaaccggggaccctccctcagaacaaccacagtgaccggcaagatcattcacgaatggtgttgccggagctgtacgctgcctcccctgcgcttcagaggcgaggacgggtgctggtatggaatggagatccggccggtcaaagaaaaggaggaaaatcttgtgaagtctatggtttccgctggcagcggggaggtggactccttttctctcggactgctgtgtattagcatcatgattgaagaggtcatgagatcccgctggtctcggaaaatgctcatgacaggcaccctggtggttttccttctgctcatcatggggcagctgacatggaacgatctgattagactttgcatcatggtgggagccaatgccagcgaccgcatgggcatgggcaccacctacctggctctcatggccacatttaagatgagacctatgttcgcggtcgggctgctctttcggcgcctgacgtccagagaggtgcttctgctcaccatcggactgtctctggtggctagcgtcgaacttcccaactccctggaggaactcggcgatgggctggccatgggaattatgatcctcaaactgcttacagacttccaaagccatcagctgtgggccaccctcctgtctctgacatttattaagaccacgttctcccttcactatgcttggaaaacaatggccatggttctgagcatcgtgtctctctttcccctgtgtctctccaccaccagccagaagacaacctggctgcctgtgcttctgggctctctggggtgcaagccgctcacaatgttcctgattgctgagaataaaatctggggacggcgctcctggccccttaacgaaggcatcatggccgtcggcattgtgagcatcctgctctccagcctgctcaagaacgatgttcctctggcggggccccttattgccggaggcatgctgatcgcttgttacgtgatttctgggagctccgccgacctgtctctcgagaaagctgccgaggtcagctgggaagaggaagccgagcattccggagcttctcacaatatcctggtggaagttcaggatgacggcacgatgaagatcaaagatgaggagagagacgatacccttacaattctgctcaaggcgaccctgctcgccgtgagcggggtctatcctctgtccatccccgctacactttttgtgtggtacttctggcagaagaagaagcagcggtctggagtcctgtgggacaccccttcccctcccgaagtggagcgcgccgttctggatgacggcatttatagaatcatgcagcggggcctcctggggcgctcccaggtgggagtcggcgtgttccaagaaaacgtttttcatacgatgtggcacgtgaccagaggggccgtccttatgtaccagggaaaacggctggagcccagctgggcttctgtgaagaaagacctcatttcctacggcgggggatggagactgcagggcagctggaatacaggcgaggaagtgcaggttatcgccgtcgagcccgggaagaaccctaaaaatgtgcaaaccgcgcccggaacattcaagaccccggaaggcgaggtgggggctattgccctcgattttaagcctggaacatctggctcccccatcgtcaaccgcgaagggaaaatcgtgggactgtatggcaatggcgttgtgacgaccagcgggacatacgtctccgccattgctcaggccaaggcgtctcaggagggacctcttcccgagatcgaagacgaggtgttccggaaaagaaacctgaccattatggatctgcaccccggcagcgggaagacccgccggtatctccctgctatcgttagagaagccattaaacgcaagctgcggacacttatcctggccccgacgagagtggtcgcttccgagatggccgaagctctcaagggaatgcccatccgctaccaaaccacagccgtgaaaagcgagcataccggcaaggagattgttgacctgatgtgccacgcgacatttaccatgcggctgctctctcctgtgagagtccccaattataacatgatcattatggatgaagcccatttcacggacccttccagcatcgctgcccgggggtacatttctacacgcgtgggcatgggagaggctgccgccatctttatgaccgctacaccccctggcagcgtggaagcgttcccgcagtccaatgccgtcatccaggatgaggaaagagacattcccgagcggtcttggaacagcgggtatgagtggatcacagattttcctggaaaaaccgtttggttcgtgccctccattaagtctggcaatgacatcgctaactgtcttcgcaaaaatgggaagagagtgattcagctgagccggaagacatttgataccgaataccagaaaacgaagaacaacgactgggactacgtcgtgacaaccgatatctccgagatgggagccaatttcagagccgaccgcgttattgatcctcggagatgcctgaaacccgtgatcctcaaggacggcccggaacgcgtcatcctggctgggcctatgcccgtgacagttgccagcgcggctcagcggagaggccgcattggacggaaccacaataaagagggcgatcagtatatctacatggggcagccccttaacaatgacgaggatcatgcccactggaccgaagccaagatgctgctcgacaacattaatacgcctgagggaatcattcccgctctgttcgaacctgagagagaaaagtctgccgcgatcgatggcgagtatcgcctgagaggggaggcccggaaaacctttgtggaactcatgcgcagaggagaccttccggtctggctgtcctacaaggtggctagcgagggcttccaatattccgatcggcgctggtgctttgacggggaaagaaacaatcaggtcctggaggaaaacatggatgtggagatctggacaaaagagggcgaacggaagaaactcagaccccgctggctggacgcccggacctactctgaccctcttgctctgagagagttcaaggaatttgccgctggacgccggagcgtttccggcgatctcattctggagatcgggaaactgccccagcacctcacacagagagcccaaaatgcgcttgacaacctggtgatgctgcataattctgaacagggaggccgggcctatcgccacgctatggaggagctccctgataccattgaaacactgatgcttctggccctcatcgctgtgctgaccgggggagtcacgctgttctttctcagcggcagaggccttgggaagacatccattggactgctgtgtgttatggccagctctgtgctcctgtggatggcctccgtggagccccattggatcgctgcgagcatcattcttgagttctttctgatggtcctcctgatcccggagcctgaccggcagcgcacaccccaagataaccaactggcctacgtggttattggcctccttttcatgatcctgaccgtggctgccaatgagatggggctgctcgaaaccaccaagaaagacctgggaattggccacgtcgccgtggggaaccaccatcacgctgccatgcttgatgtcgacctgcatcctgcgtctgcctggacactctacgctgtggccacgaccatcattacacccatgatgagacacaccatcgagaacacaaccgctaatatctccctgacggccattgcgaaccaggccgctatcctgatgggactcgataagggctggcctattagcaaaatggacatcggcgttccccttctggccctggggtgctattctcaggtgaatccgctcaccctgacagctgccgtccttatgctggtggctcattacgccattatcggacctggcctccaagcgaaggccacccgggaagctcagaaacgcacagccgctgggatcatgaagaaccccaccgttgatggaattgtggccatcgacctggatcccgtcgtgtatgacgccaagtttgagaaacagctgggccagattatgctccttatcctgtgtacgagccaaattctgctcatgagaacaacctgggcgctgtgcgaatccatcacacttgctaccgggcctctgaccacactctgggagggatctccgggcaagttctggaatacgaccatcgccgtgagcatggctaacatttttcggggctcctacctggccggggccggactggctttcagcctcatgaaatcccttggcgggggacgcagaggcacaggggcccagggagagaccctgggcgaaaagtggaaacggcagctgaatcagctctctaagagcgagttcaacacatataagagatccggcatcatggaagttgaccgctctgaggcgaaagaagggctgaagcggggagagaccacgaaacacgccgtcagcagaggcacagctaaacttcgctggtttgtggagcggaatctggtgaaacccgaagggaaggtcattgatctcggatgtggcagagggggatggtcctactattgcgccggcctgaagaaagttaccgaggtgaagggctacaccaaagggggacctggccacgaagaacccatccctatggctacatacgggtggaacctggtgaagctccattctggaaaagacgtcttctttattccccctgaaaagtgtgatacccttctgtgcgacatcggcgagagctccccgaatcccacaattgaggaagggcgcacgctgcgggtgctcaaaatggttgagccttggctgagaggaaaccaattctgtatcaagatccttaatccctatatgcctagcgtggtcgaaaccctggagcagatgcagcgcaagcacggcggcatgctcgtgcggaaccccctgtctagaaattccacacatgagatgtactgggttagctgcgggaccggaaacattgtgtctgccgtcaatatgacatcccgcatgctgctcaaccggtttaccatggcgcacagaaaaccgacgtatgaacgcgatgtggacctgggcgccgggaccagacacgtggctgtcgagcctgaagttgccaaccttgatatcattggacagcggatcgagaatattaagcatgaacacaaaagcacatggcattacgacgaggataacccctataagacctgggcttaccacggctcttatgaggtgaaaccctccgggagcgcctccagcatggtgaatggagtcgtgaagctgctcacaaagccttgggacgttatccccatggtgacccaaatcgctatgacagataccacgcctttcggccagcagcgcgtctttaaagaaaaggtggacacaagaaccccgaaagccaagcggggcaccgcgcaaattatggaggttacagccaaatggctgtgggggttcctttctagaaacaagaagccccggatctgtacgcgcgaagagtttaccagaaaagtgcggagcaatgctgccattggagctgtcttcgtggacgaaaaccagtggaactccgccaaggaggccgttgaggatgaacgcttttgggacctggtgcatagagagcgggaactccacaaacagggcaagtgcgcgacatgcgtctacaacatgatggggaaacgcgagaagaagctgggagagttcggcaaagctaaggggtctagagccatctggtacatgtggctgggcgcccggtttctcgagttcgaggctctgggattcatgaatgaagatcactggtttagccgcgagaactccctttctggcgtggaaggggagggactgcataaactcggctatattctgagagacatcagcaagatccctgggggaaatatgtacgccgatgacaccgctggctgggatacacggattaccgaggacgatcttcagaacgaagcccgcatcacagacattatggagcccgaacacgcgctgctcgccaaatccatcttcaagctgacctatcaaaataaagtcgtgagagttcagcggcctgctaagaacgggacggtgatggatgtcatttctcgcagagaccagcggggcagcggacaggtgggcacctacgggctgaatacatttaccaacatggaggcccaactcatcagacagatggaatccgagggaatcttcagcccctctgagctggaaacaccgaaccttgctgagcgcgtgctggattggctcgaaaagtatggcgttgagcggctgaaaagaatggccatttccggggacgactgtgtggtcaagcctatcgatgaccgctttgcgaccgcccttacggctctgaatgatatgggaaaagtgcggaaggacattccccagtgggaacctagcaaaggctggaacgattggcagcaagttcccttctgctctcatcactttcaccagctcatcatgaaggacgggagagagattgtggtcccttgtcgcaatcaggatgagctggtgggccgggccagagtctcccagggagctggctggagcctgcgcgaaacagcctgcctcgggaagtcctacgctcaaatgtggcagctgatgtatttccatcggagagaccttcgcctggccgcgaacgccatctgttctgctgtgcccgttgattggattccgaccagccggacaacctggtccatccacgcccatcaccagtggatgacgaccgaggacatgctcagcgtgtggaatagagtctggatcgaagagaacccttggatggaagataaaacacatatttcttcctggggagacgtgccctacctgggcaagcgggaggaccaatggtgcgggagccttatcggactgaccgccagagctacatgggccaccaatattcaggttgcgatcaaccaggtgcgccggctcattggcaatgagaactacctggattatatgacatctatgaaaagatttaagaatgaaagcgaccccgagggggctctgtggtga

SEQ ID NO: 18589 - RNA, 9879 nt, synthetic construct
  misc_feature 1..9879: note = derived and/or modified CDS sequence (opt5) from DENV-1__HM181959__SS-prME
  source 1..9879: mol_type = other RNA
agcgtgaccatgctgctcatgctgatgcccacagcccttgctttccacctgacgaccagaggcggggagcctcatatgatcgtctccaagcaggaacgggggaaatctctcctgtttaagaccagcgccggcgttaatatgtgcacccttatcgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagtctgcctggaaacagatccagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtggactcttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcagcacccaagatgaaaagggcgttacacagaacgggcggctgattacggctaatcccatcgtgaccgacaaagagaagcctgtcaacattgaagccgagccgccctttggagagtcttatatcgtgattggcgccggggaaaaagctcttaagctcagctggttcaagaaaggatcctctatcggcaagatgtttgaggccacagctagaggggcccgccggatggcgatcctgggcgataccgcctgggacttcggaagcattggcggggtgtttacatccgttggaaaactggtccatcagatcttcggcaccgcttacggggtgctctttagcggagtgtcttggacgatgaagattggcatcggggtcctgcttacctggctgggcctcaattccagaagcacatctctgtccatgacctgtattgccgtgggactggttacactttacctcggcgtgatggtccaggctgatagcgggtgcgtgatcaactggaaaggacgcgaactgaagtgtggctccgggattttcgttaccaatgaggtgcacacatggaccgaacaatataagtttcaggccgactctcctaaacggctgagcgcggccatcggaaaggcttgggaggagggcgtctgcgggatcagatccgccacgcgcctcgaaaacattatgtggaaacagatctctaacgagctgaatcatattcttctggaaaacgacatgaagttcacagtggttgtgggcgatgtcgctggaatcctcgcccagggcaaaaagatgattcggccgcaacccatggagtacaaatatagctggaagtcctgggggaaggccaaagtgatcggagctgacgtgcagaataccacctttatcattgatggccctaacacacccgaatgtcctgacgatcagagagcgtggaatatctgggaggtcgaggactacgggttcggaatttttaccacgaacatctggctgaagctgcgcgatagctatacacaggtttgcgaccaccggcttatgtctgccgctattaaagattccaaggccgtgcacgccgacatgggctactggatcgaaagcgagaaaaatgaaacctggaagctcgctagagcctctttcatcgaggtgaagacatgtatttggcccaaatcccataccctgtggagcaacggcgtcctggaatctgagatgatcattccgaagatctatgggggacctattagccaacacaattaccgccccggctacttcacacagaccgcggggccttggcatctcggaaaactggagcttgattttgacctgtgcgaaggcacgaccgtggttgtggatgagcactgcgggaaccggggaccctccctcagaacaaccacagtcaccggcaagatcatccacgaatggtgttgccggagctgtacgctgcctcccctgcgcttcagaggcgaggacgggtgctggtatggaatggagattcggccggtgaaagaaaaggaggaaaatcttgttaagtctatggtgtccgctggcagcggggaggtcgactccttttctctcggactgctgtgtatcagcattatgatcgaagaggtgatgagatcccgctggtctcggaaaatgctcatgacaggcaccctggttgtgttccttctgctcattatggggcagctgacatggaacgatctgatcagactttgcattatggtcggagccaatgccagcgaccgcatgggcatgggcaccacctacctggctctcatggccacatttaagatgagacctatgttcgcggtggggctgctctttcggcgcctgacgtccagagaggtgcttctgctcaccatcggactgtctctggtcgctagcgttgaacttcccaactccctggaggaactcggcgatgggctggccatgggaatcatgattctcaaactgcttacagacttccaaagccatcagctgtgggccaccctcctgtctctgacatttatcaagaccacgttctcccttcactatgcttggaaaacaatggccatggtgctgagcattgtgtctctctttcccctgtgtctctccaccaccagccagaagacaacctggctgcctgtccttctgggctctctggggtgcaagccgctcacaatgttcctgatcgctgagaataaaatttggggacggcgctcctggccccttaacgaaggcatcatggccgtgggcatcgttagcattctgctctccagcctgctcaagaacgatgtgcctctggcggggccccttatcgccggaggcatgctgattgcttgttacgtcatctctgggagctccgccgacctgtctctcgagaaagctgccgaggtgagctgggaagaggaagccgagcattccggagcttctcacaatattctggttgaagtgcaggatgacggcacgatgaagatcaaagatgaggagagagacgatacccttacaatcctgctcaaggcgaccctgctcgccgtcagcggggtgtatcctctgtccattcccgctacactttttgtctggtacttctggcagaagaagaagcagcggtctggagtgctgtgggacaccccttcccctcccgaagttgagcgcgccgtgctggatgacggcatctatagaattatgcagcggggcctcctggggcgctcccaggtcggagtgggcgttttccaagaaaacgtgtttcatacgatgtggcacgtcaccagaggggccgtgcttatgtaccagggaaaacggctggagcccagctgggcttctgtgaagaaagacctcatctcctacggcgggggatggagactgcagggcagctggaatacaggcgaggaagttcaggtcattgccgtggagcccgggaagaaccctaaaaatgtgcaaaccgcgcccggaacattcaagaccccggaaggcgaggtcggggctatcgccctcgattttaagcctggaacatctggctcccccattgtgaaccgcgaagggaaaatcgttggactgtatggcaatggcgtggtcacgaccagcgggacatacgtgtccgccatcgctcaggccaaggcgtctcaggagggacctcttcccgagattgaagacgaggttttccggaaaagaaacctgaccatcatggatctgcaccccggcagcgggaagacccgccggtatctccctgctattgtgagagaagccatcaaacgcaagctgcggacacttattctggccccgacgagagtcgtggcttccgagatggccgaagctctcaagggaatgcccatccgctaccaaaccacagccgttaaaagcgagcataccggcaaggagatcgtggacctgatgtgccacgcgacatttaccatgcggctgctctctcctgtcagagtgcccaattataacatgattatcatggatgaagcccatttcacggacccttccagcattgctgcccgggggtacatctctacacgcgtgggcatgggagaggctgccgccatttttatgaccgctacaccccctggcagcgtcgaagcgttcccgcagtccaatgccgttatccaggatgaggaaagagacatccccgagcggtcttggaacagcgggtatgagtggattacagattttcctggaaaaaccgtgtggttcgtgccctccatcaagtctggcaatgacattgctaactgtcttcgcaaaaatgggaagagagtcatccagctgagccggaagacatttgataccgaataccagaaaacgaagaacaacgactgggactacgtggttacaaccgatatttccgagatgggagccaatttcagagccgaccgcgtgatcgatcctcggagatgcctgaaacccgtcattctcaaggacggcccggaacgcgtgatcctggctgggcctatgcccgttacagtggccagcgcggctcagcggagaggccgcatcggacggaaccacaataaagagggcgatcagtatatttacatggggcagccccttaacaatgacgaggatcatgcccactggaccgaagccaagatgctgctcgacaacatcaatacgcctgagggaattatccccgctctgttcgaacctgagagagaaaagtctgccgcgattgatggcgagtatcgcctgagaggggaggcccggaaaacctttgtcgaactcatgcgcagaggagaccttccggtgtggctgtcctacaaggtcgctagcgagggcttccaatattccgatcggcgctggtgctttgacggggaaagaaacaatcaggtgctggaggaaaacatggatgttgagatctggacaaaagagggcgaacggaagaaactcagaccccgctggctggacgcccggacctactctgaccctcttgctctgagagagttcaaggaatttgccgctggacgccggagcgtgtccggcgatctcatcctggagattgggaaactgccccagcacctcacacagagagcccaaaatgcgcttgacaacctggtgatgctgcataattctgaacagggaggccgggcctatcgccacgctatggaggagctccctgataccatcgaaacactgatgcttctggccctcattgctgtcctgaccgggggagttacgctgttctttctcagcggcagaggccttgggaagacatccatcggactgctgtgtgtgatggccagctctgtgctcctgtggatggcctccgtcgagccccattggattgctgcgagcatcatccttgagttctttctgatggtgctcctgattccggagcctgaccggcagcgcacaccccaagataaccaactggcctacgttgtgatcggcctccttttcatgattctgaccgtcgctgccaatgagatggggctgctcgaaaccaccaagaaagacctgggaatcggccacgtggccgtcgggaaccaccatcacgctgccatgcttgatgtggacctgcatcctgcgtctgcctggacactctacgctgttgccacgaccattatcacacccatgatgagacacaccattgagaacacaaccgctaatatctccctgacggccatcgcgaaccaggccgctattctgatgggactcgataagggctggcctatcagcaaaatggacattggcgtgccccttctggccctggggtgctattctcaggtcaatccgctcaccctgacagctgccgtgcttatgctggttgctcattacgccatcattggacctggcctccaagcgaaggccacccgggaagctcagaaacgcacagccgctgggatcatgaagaaccccaccgtggatggaatcgtcgccattgacctggatcccgtggtgtatgacgccaagtttgagaaacagctgggccagatcatgctccttattctgtgtacgagccaaatcctgctcatgagaacaacctgggcgctgtgcgaatccattacacttgctaccgggcctctgaccacactctgggagggatctccgggcaagttctggaatacgaccatcgccgttagcatggctaacatctttcggggctcctacctggccggggccggactggctttcagcctcatgaaatcccttggcgggggacgcagaggcacaggggcccagggagagaccctgggcgaaaagtggaaacggcagctgaatcagctctctaagagcgagttcaacacatataagagatccggcattatggaagtcgaccgctctgaggcgaaagaagggctgaagcggggagagaccacgaaacacgccgtgagcagaggcacagctaaacttcgctggtttgtggagcggaatctggtcaaacccgaagggaaggttatcgatctcggatgtggcagagggggatggtcctactattgcgccggcctgaagaaagtgaccgaggtgaagggctacaccaaagggggacctggccacgaagaacccattcctatggctacatacgggtggaacctggtcaagctccattctggaaaagacgtgttctttattccccctgaaaagtgtgatacccttctgtgcgacattggcgagagctccccgaatcccacaatcgaggaagggcgcacgctgcgggttctcaaaatggtggagccttggctgagaggaaaccaattctgtattaagatccttaatccctatatgcctagcgtcgtggaaaccctggagcagatgcagcgcaagcacggcggcatgctcgttcggaaccccctgtctagaaattccacacatgagatgtactgggtgagctgcgggaccggaaacatcgtctctgccgtgaatatgacatcccgcatgctgctcaaccggtttaccatggcgcacagaaaaccgacgtatgaacgcgatgtggacctgggcgccgggaccagacacgtcgctgttgagcctgaagtggccaaccttgatattatcggacagcggattgagaatatcaagcatgaacacaaaagcacatggcattacgacgaggataacccctataagacctgggcttaccacggctcttatgaggtgaaaccctccgggagcgcctccagcatggtcaatggagtggttaagctgctcacaaagccttgggacgtgattcccatggtcacccaaatcgctatgacagataccacgcctttcggccagcagcgcgtgtttaaagaaaaggttgacacaagaaccccgaaagccaagcggggcaccgcgcaaatcatggaggtgacagccaaatggctgtgggggttcctttctagaaacaagaagccccggatttgtacgcgcgaagagtttaccagaaaagtccggagcaatgctgccatcggagctgtgttcgttgacgaaaaccagtggaactccgccaaggaggccgtggaggatgaacgcttttgggacctggtccatagagagcgggaactccacaaacagggcaagtgcgcgacatgcgtgtacaacatgatggggaaacgcgagaagaagctgggagagttcggcaaagctaaggggtctagagccatttggtacatgtggctgggcgcccggtttctcgagttcgaggctctgggattcatgaatgaagatcactggtttagccgcgagaactccctttctggcgtcgaaggggagggactgcataaactcggctatatcctgagagacattagcaagatccctgggggaaatatgtacgccgatgacaccgctggctgggatacacggatcaccgaggacgatcttcagaacgaagcccgcattacagacatcatggagcccgaacacgcgctgctcgccaaatccattttcaagctgacctatcaaaataaagtggttagagtgcagcggcctgctaagaacgggacggtcatggatgtgatctctcgcagagaccagcggggcagcggacaggtgggcacctacgggctgaatacatttaccaacatggaggcccaactcattagacagatggaatccgagggaatcttcagcccctctgagctggaaacaccgaaccttgctgagcgcgttctggattggctcgaaaagtatggcgtggagcggctgaaaagaatggccatctccggggacgactgtgtcgtgaagcctattgatgaccgctttgcgaccgcccttacggctctgaatgatatgggaaaagttcggaaggacatcccccagtgggaacctagcaaaggctggaacgattggcagcaagtgcccttctgctctcatcactttcaccagctcattatgaaggacgggagagagatcgtcgtgccttgtcgcaatcaggatgagctggtcggccgggccagagtgtcccagggagctggctggagcctgcgcgaaacagcctgcctcgggaagtcctacgctcaaatgtggcagctgatgtatttccatcggagagaccttcgcctggccgcgaacgccatttgttctgctgttcccgtggattggatcccgaccagccggacaacctggtccattcacgcccatcaccagtggatgacgaccgaggacatgctcagcgtctggaatagagtgtggatcgaagagaacccttggatggaagataaaacacatatctcttcctggggagacgttccctacctgggcaagcgggaggaccaatggtgcgggagccttattggactgaccgccagagctacatgggccaccaatatccaggtggcgattaaccaggtccgccggctcatcggcaatgagaactacctggattatatgacatctatgaaaagatttaagaatgaaagcgaccccgagggggctctgtggtga

SEQ ID NO: 18590 - RNA, 9879 nt, synthetic construct
  misc_feature 1..9879: note = derived and/or modified CDS sequence (opt5) from DENV-1__JF937651__SS-prME
  source 1..9879: mol_type = other RNA
agcgtgaccatgctgctgatgctgatgcccacagctcttgctttccacctgacgaccagaggcggggagcctcatatgatcctctccaagcaggaacggggaaaatctctgctttttaagaccagcgccggcgtcaatatgtgcaccctgatcgcgatggacctcggggagctgtgtgaagatacaatgacctacaaatgcccgcgcatcacagaggctgaacccgacgatgttgactgttggtgcaatgccaccgatacgtgggtgacctatggaacatgttcccaaaccggcgagcacagacgggacaagcgctctgtggccctggctcctcatgtcgggctcggactggagacaagaaccgaaacgtggatgagctccgagggcgcctggaaacagattcagcgggtggaaacatgggcccttcgccaccccggcttcaccgttatcgccctgtttctcgcgcatgccattgggacatctatcacccagaagggaatcattttcatcctgcttatgctggtgacccctagcatggctatgagatgcgtcggcattgggtcccgggattttgtggagggactcagcggcgccacatgggttgacgtggtcctggagcacgggtcttgtgtgacgaccatggctaaggataaacccacactggacatcgaactcctgaagaccgaggtgacaaaccctgccattcttcgcaaactgtgcatcgaagcgaagatttccaataccacgacagatagcagatgtccgacccaaggagaggccaccctcgtcgaagaacaagacgctaacttcgtttgccggcgcacatttgtggatagaggctggggcaatgggtgtggactgttcggcaaagggtctcttattacctgcgccaagtttaagtgcgtgacaaaactggagggaaagatcgtccagtacgaaaacctcaaatattccgtgattgttacggtgcacaccggcgaccagcatcaagtcgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgttcataagcagtggtttctggatcttcctctgccctggacaagcggggcttccacctctcaagagacatggaatcgccaggacctcctggtgaccttcaaaaccgcgcacgccaagaagcaggaagtcgtggtcctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagttgccgagacccagcacggaaccgtgctggtccagatcaagtacgagggcacagacgcgccgtgcaaaatccctttctccacccaagatgaaaagggggtgacacagaacggacggcttattacggctaatcccatcgttaccgacaaagagaagcctgtgaacattgaagccgagccgccctttggcgagagctatatcgtcattggggccggagaaaaagctctcaagctgtcttggttcaagaaaggcagctccatcgggaagatgtttgaggccacagctagaggcgcccgccggatggcgatcctgggagataccgcctgggacttcggctctattgggggagtgtttacaagcgtgggcaaactcatccatcagattttcgggaccgcttacggagttctgttttccggcgtcagctggacgatgaagatcgggattggcgtgcttctgacctggctcggactcaattctagatccacaagcctgtctatgacctgtatcgccgtgggccttgtcacactctacctgggggtgatggttcaggctgattccggatgcgtgattaactggaaaggccgcgaactgaagtgtgggagcggaatcttcgtcaccaatgaggtgcacacatggaccgaacaatataagtttcaggccgactcccctaaacggctctctgcggccatcggcaaggcttgggaggagggggtttgcggcattagaagcgccacgcgcctggaaaacatcatgtggaaacagatttccaacgagcttaatcatatcctgctcgaaaacgacatgaagttcacagtggtcgtgggagatgttgctggcattctggcccaggggaaaaagatgatccggccgcaacccatggagtacaaatattcttggaaaagctggggaaaggccaagatcattggcgctgacgtgcagaataccacctttatcattgatgggcctaacacacccgaatgtcctgacgatcagagagcgtggaatatctgggaggtcgaggactacggattcggcatttttaccacgaacatctggctgaaacttcgcgattcctatacacaggtgtgcgaccaccggctcatgagcgccgctatcaaagattctaaggccgtgcacgccgacatgggctactggattgaatccgagaaaaatgaaacctggaagctggctagagccagcttcatcgaggtcaagacatgtatttggcccaaatctcataccctgtggtccaacggggttctcgaaagcgagatgatcattccgaagatctatggaggccctatctctcaacacaattaccgccccgggtacttcacacagaccgcgggaccttggcatctgggcaaacttgagctggattttgacctctgcgaagggacgaccgtggtggtcgatgagcactgcggaaaccggggccccagcctgagaacaaccacagtgaccggcaagattatccacgaatggtgttgccggtcctgtacgctgcctccccttcgcttcagaggggaggacggatgctggtatggcatggagattcggccggttaaagaaaaggaggaaaatctcgtgaagtccatggtctctgctgggtccggagaggtggacagcttttccctgggcctgctctgtatctctattatgatcgaagaggttatgagaagccgctggtcccggaaaatgctgatgacagggacccttgccgtgttcctgctcctgattatgggacagctgacatggaacgatcttatcagactgtgcatcatggtcggcgccaatgcttgtgaccgcatgggcatggggaccacctacctcgccctgatggcgacatttaagatgagacctatgttcgctgtgggactcctgtttcggcgccttacgtctagagaggttctgctcctgaccattggcctgagccttgtggcctccgtcgaactgcccaactctctcgaggaactgggggatggactcgccatgggcatcatgattctgaaacttctgacagacttccaaagctatcagctctgggctaccctgctgtcccttacatttatcaagaccacgttcagcctgcattacgcctggaaaacaatggctatggtgctctctattgtgtccctgtttcccctctgcctgagcaccacctctcagaagacaacctggcttcctgtcctgctggggtccctcggatgtaagccgctgacaatgttccttatcgccgagaataaaatctggggccggcgcagctggcccctgaacgaaggcattatggcggttgggatcgtgtctattctcctgtccagcctcctgaagaacgatgtgcctcttgccggacccctgatcgctggcgggatgctgattgcctgctatgtcatctccggaagctctgctgacctcagcctggagaaagccgccgaggtgtcctgggaagaggaagctgagcactctggcgcgagccataatatccttgttgaagtgcaggatgacgggacgatgaagattaaagatgaggagagagacgataccctgacaatcctcctgaaggccaccctcctggctgtctccggagtgtaccctctttctattcccgccacactgtttgtttggtatttctggcagaagaagaagcagcggagcggcgtgctgtgggacacccctagccctcccgaagtcgagcgcgccgtgctcgatgacggcatctacagaattatgcagcgggggctgcttggacgctctcaggtcggcgtgggggttttccaagaaaacgtgtttcacacgatgtggcatgtcaccagaggagctgtgctgatgtaccagggcaaacggctcgagcccagctgggcctccgttaagaaagacctgatcagctatgggggaggctggagactccagggctcttggaatacaggggaggaagtgcaggtcattgcggtggagcccggaaagaaccctaaaaatgtgcaaaccgctcccggcacattcaagaccccggaaggggaggttggagccatcgccctggattttaagcctggcacatccgggagccccatcgtcaaccgcgaaggaaaaattgtgggcctttacggcaatggggtggtcacgacctctggaacatatgtgtccgctatcgcccaggcgaaggctagccaggagggccctctgcccgagattgaagacgaggttttccggaaaagaaacctgaccatcatggatctccaccccgggtccggaaagacccgccggtacctgcctgccattgtgagagaagccatcaaacgcaaacttcggacactgatcctcgctccgacgagagtcgtggcctctgagatggctgaagccctgaagggcatgcccattcgctatcaaaccacagcggttaaaagcgagcacaccgggaaggagatcgtggacctgatgtgtcatgccacatttaccatgcggctcctttcccctgtcagagtgcccaattacaacatgattatcatggatgaagctcacttcacggaccctagctctattgccgctcggggctatatctccacacgcgttggaatgggcgaggccgccgctatctttatgaccgcgacaccccctgggagcgtggaagccttcccgcagtctaatgctgtcattcaggatgaggaaagagacatccccgagcggagctggaactccggatacgagtggattacagattttcctggcaaaaccgtgtggttcgtgccctctatcaagagcgggaatgacattgccaactgcctgcgcaaaaatggaaagagagtcatccagctgtcccggaagacatttgataccgaataccagaagacgaagaacaacgactgggactatgttgtgacaaccgatatttctgagatgggcgccaatttcagagctgaccgcgtgatcgatcctcggagatgcctcaaacccgtcatcctgaaggacgggccggaacgcgtgattcttgccggccctatgcccgttacagtggcgagcgctgcccagcggagaggacgcatcggccggaaccataataaagagggggatcagtacatttatatgggacagcccctgaacaatgacgaggatcacgcccattggaccgaagctaagatgctcctggacaacatcaatacgcctgagggcattatccccgccctgttcgaacctgagagagaaaagtccgcggccatcgatggggagtaccgcctcagaggagaggctcggaaaacctttgtcgaacttatgcgcagaggcgacctgccggtgtggctgagctataaggttgcctctgaggggttccaatactccgatcggcgctggtgttttgacggcgaaagaaacaatcaggtgctcgaggaaaacatggatgtcgagatttggacaaaagagggagaacggaagaaactgagaccccgctggcttgacgctcggacctatagcgaccctctggccctcagagagttcaaggaatttgctgccggccgccggtccgtgtctggggatctgatcctggagattggaaaactcccccagcaccttacacagagagcgcaaaatgccctggacaacctggtcatgctccacaatagcgaacagggcgggcgggcttaccgccatgccatggaggagctgcctgataccatcgaaacacttatgctgctcgctctgattgccgtgctgaccggaggcgttacgctgttctttctttccggcagagggctgggaaagacatctatcggcctgctctgcgtgatggccagctccgtgctgctttggatggctagcgtcgagccccactggatcgcggcctctattatcctggagttctttctcatggttctgctgattccggagcctgaccggcagcgcacaccccaagataaccaactcgcttacgtggtgatcgggcttctgttcatgattctgaccgtcgccgccaatgagatgggactcctggaaaccaccaagaaagaccttggcatcgggcatgtggctgttggaaaccaccaccatgccgcgatgctggatgtggacctccaccctgcctccgcttggacactgtatgccgtcgctacgaccattatcacacccatgatgaagcataccatcgagaacacaaccgccaatattagcctgacggcgatcgccaaccaggctgccattctcatgggccttgataaaggctggcctatctctaagatggacattggggtgcccctgctggctctcggatgttactcccaggtcaatccgctgacccttacagccgctgtgctgatgctcgttgcccactatgcgatcatcggccctgggctgcaagccaaagctaccagagaagcccagaagcggacagctgccggaattatgaagaaccccaccgtggatggcatcgtcgccattgacctggatcccgtggtttacgacgcgaaatttgagaagcagctcgggcagatcatgcttctgattctgtgcacgagccaaatcctcctgatgcgcacaacctgggctctttgtgaatctatcacactggccaccggacctctcaccacactgtgggagggcagcccgggcaaattctggaatacgaccattgctgtgtccatggccaacatctttagagggtcttatctggccggagctggcctcgccttcagccttatgaagtccctcgggggcgggcggcgcgggacaggagcgcagggcgagaccctgggcgaaaaatggaagagacagctcaatcagctgagcaagtccgagttcaacacatacaaacggtctgggattatggaagtcgacagaagcgaggccaaggaaggacttaaacgcggcgagaccacgaagcatgctgtgtcccgggggacagccaaactgagatggtttgtggagcgcaatctcgttaagcccgaaggaaaggtcatcgatctgggctgcgggcggggaggctggtcttattactgtgctggcctgaaaaaggtgaccgaggtgaaagggtacaccaagggaggccctgggcacgaagaacccattcctatggccacatatggatggaacctcgtcaaacttcacagcggcaaggacgttttctttattccccctgaaaaatgcgataccctgctgtgtgacatcggggagtcctctccgaatcccacaatcgaggaaggaagaacgctccgcgtgctgaagatggtggagccttggcttcggggcaaccaattctgcatcaagattctgaatccctacatgcctagcgtcgtggaaaccctcgagcagatgcagagaaaacatggcgggatgctggttcgcaaccccctgtcccggaatagcacacacgagatgtattgggtgtcttgtggaaccggcaacatcgtctccgcggtgaatatgacaagcagaatgctcctgaaccgctttaccatggcccatcggaagccgacgtacgaaagagatgttgaccttggggctggaacccgccacgtggccgtcgagcctgaagtggctaacctggatattatcggccagagaattgagaatatcaaacacgaacataagtctacatggcactatgacgaggataacccctacaaaacctgggcctatcatgggtcctacgaggtgaagcccagcggatctgcttccagcatggtcaatggcgttgtgaagctcctgacaaaaccttgggacgtgatccccatggtcacccaaattgccatgacagataccacgcctttcggccagcagcgggtgtttaaggaaaaagttgacacacgcaccccgaaggcgaaaagagggaccgcccaaatcatggaggtgacagctaagtggctttggggattcctgtcccggaacaagaaacccagaatttgcacgcgggaagagtttaccggcaaggtccgcagcaatgccgctatcggggccgtgttcgttgacgaaaaccagtggaactctgccaaagaggcggtggaggatgaaagattttgggacctcgtccaccgggagcgcgaactgcataagcagggaaaatgcgctacatgtgtgtacaacatgatgggcaagagagagaagaaactgggggagttcggcaaggccaaaggaagccgggccatttggtatatgtggctcggcgctcgctttctggagttcgaggcccttgggttcatgaatgaagatcactggttttccagagagaactctctgagcggagttgaaggcgaggggctccacaagctgggatacatccttcgggacatctccaaaattcctggcgggaatatgtatgctgatgacaccgccggctgggatacacgcatcaccgaggacgatctgcagaacgaagcgagaattacagacatcatggagcccgaacatgccctcctggctaagtctattttcaaactgacctaccaaaataaggtggtccgggtgcagcgccctgccaagaacggaacggtcatggatgtgatcagcagacgggaccagcgcggctccgggcaggttggaacctatggcctcaatacatttaccaacatggaggctcaactgatcagacagatggaatctgaggggattttcagcccctccgagcttgaaacaccgaacctggccgagcgggtgctcgattggctggaaaaatacggagtcgagagacttaagcgcatggcgatcagcggcgacgactgcgtggtgaaacctattgatgaccggtttgccaccgctctgacggccctcaatgatatggggaaggttagaaaagacatcccccagtgggaaccttctaagggctggaacgattggcagcaagtgcccttctgttcccaccattttcaccagctgattatgaaggacggacgcgagatcgtcgtgccttgccggaatcaggatgagctggttggcagagctcgcgtgagccagggggccggatggtctctccgggaaacagcttgtctgggcaaatcctatgcccaaatgtggcagcttatgtacttccacagacgcgacctgcggctcgcggccaacgctatttgcagcgccgtccccgtggattggatcccgacctccagaacaacctggtctatccatgcccaccatcagtggatgacgaccgaggacatgctgagcgtctggaatcgcgtgtggattgaagagaacccttggatggaagataagacacacatctccagctggggagacgttccctaccttggaaaacgggaggaccaatggtgtggctctctgattgggctcaccgctagagccacatgggcgaccaatatccaggtggctattaaccaggtccggagactgatcggcaatgagaactatctggattacatgacatccatgaagcgctttaaaaatgaaagcgaccccaagggagccctctggtga

SEQ ID NO: 18591 - RNA, 9879 nt, synthetic construct
  misc_feature 1..9879: note = derived and/or modified CDS sequence (opt5) from DENV-1__GU131956__SS-prME
  source 1..9879: mol_type = other RNA
agcgtgaccatgctgctcatgctgcttcccaccgccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaaccatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagaacaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattacaccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagccgccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtgattaactggaaaggcagagaactgaagtgtgggtccggaatcttcgtcaccaacgaggtgcacacgtggacagaacagtataagtttcaggctgatagccctaaacgcctctccgccgcgattggcaaggcctgggaggagggggtttgcggcatccggtctgctaccagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacacaacctttatcatcgacgggcctgatacgcccgaatgtcctgacaatcagcgggcttggaacatttgggaggtggaggattatggattcggcatctttacaaccaatatttggctgaaacttagagacagctacacacaaatgtgcgatcaccgcctcatgtccgcggccatcaaagacagcaaggctgtccatgccgatatgggctattggattgaatctgagaaaaacgaaacctggaagctggcccgggcttccttcatcgaggttaagacatgtacctggcccaaaagccacacgctgtggtctaatggggtgctcgaatccgagatgatcattccgaagatctacggaggccctattagccagcataactatagacccgggtacttcacccagacagccggaccttggcacctgggcaaacttgagctggactttgatctctgcgaagggaccacagtggtcgtggacgagcactgcggaaatcgcggcccctctctgcggaccacgacagttaccggcaagatcattcatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggaccctggccgtcttccttctgctcgtgatgggacaactgacatggaatgacctgattagactttgcatcatggttggcgccaacgcttccgatcgcatgggcatggggacgacctatctggccctcatggcgacatttaaaatgagacctatgttcgctgtgggactgctctttcggcgcctgacctctagagaggtccttctgctcacaattggcctgagcctggtggcctccgtggaacttcccaactctctggaggaactcggggacggactggccatgggcatcatgatgctcaagctgcttaccgagttccagccccaccagctgtggacgacactcctgagcctgacctttattaaaaccacactttccctggattacgcttggaagaccacagccatggctctcagcatcgtctctctgttccctctctgtctgtccacgaccagccagaaaacaacctggcttccggttctgctggggtcttttggatgcaagcccctcacaatgttcctgatcaccgaaaataagatttggggccggaaatcctggcctcttaacgagggcatcatggccattgggatcgtgagcattctgctctcttccctgctcaagaatgacgtgcccctggcgggacctcttatcgccggcgggatgctgatcgcttgttatgtcattagcggatccagcgccgatctgtctctcgagaaagctgccgaagtgagctgggagcaagaagccgagcattccggcacgtctcacaacatcctggttgaagtgcaggacgatgggaccatgaagattaaagacgaggagcgcgatgacacacttaccatcctgctcaaggctacactgctcgcggtcagcggagtgtaccccatgtccattcctgccaccctgtttgtttggtatttctggcagaaaaagaagcagagatctggcgtgctttgggatacacccagcccgcctgaagtcgagcgggctgtgctggacgatggcatctaccgcatcctgcaaagagggctcctgggacggtcccaggtcggcgtgggggttttccaggacggagtgtttcatacgatgtggcacgtcacccgcggcgccgtgcttatgtatcaggggaaaagactggaaccctcttgggccagcgttaagaaagacctcatttcctacggaggcggctggcggttccaagggagctggaatacaggagaggaggtgcaggtcatcgctgtggaacctggcaagaaccccaaaaatgtgcagaccaccccggggacatttaagacgcctgagggagaagttggcgccattgcgctggatttcaagcccgggacctctggatcccctatcgtcaacagagagggcaaaattgtgggcctctacgggaatggagtggtcacaaccagcggcacatatgtgtctgctatcgcccaagccaaggcttcccaggaagggcccctgcccgagattgaggacgaagtttttaaaaagcgcaaccttaccatcatggatctgcaccctggaagcggcaaaacgcggagatacctgccggccatggtgcgcgaggcgatcaagcggaagctcagaacactgattcttgctcccacccgcgtcgtggcctccgaaatggccgaggctctgaaagggatgcctatccggtatcagaccacagccgttaagtctgaacataccggcagagagattgtggacctcatgtgccacgctacattcaccatgcgcctgctgagccccgtccgggtgcctaattacaacatgatcattatggatgaggcccattttacggaccccgcgtccatcgccgctagaggatatatcagcacacgggttggcatgggggaagccgctgccattttcatgaccgccacacctccgggatctgtggaggcttttccccagtccaatgcggtcatccaagatgaagaacgcgacattcctgaaagaagctggaactctggctacgattggatcaccgacttccccgggaaaacggtgtggtttgtgcctagcattaagtccggaaatgatatcgccaactgtctccggaaaaacggcaagcgcgtcatccagctttctagaaagaccttcgacacagagtatcagaaaaccaagaataacgactgggattacgttgtgacaaccgacattagcgagatgggggctaatttccgggccgatagagtgatcgacccccgccggtgcctgaaaccggtcattctgaaggatggccctgaaagagtgatcctcgccggacccatgcccgttacagtggcttccgccgcgcagcgccggggcagaattgggcgcaaccaaaataaagagggagaccagtacgtctatatgggccagcctctgaacaatgatgaagaccacgctcattggaccgaggccaagatgcttctggataacatcaatacgcccgaggggattatccctgccctctttgaaccggagcgggaaaagtctgctgccatcgacggagagtacagactgcgcggcgaagcgagaaaaacattcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgctcgcacctattctgatcccctggcccttcgggagtttaaggagttcgctgccgggagacgctccgtcagcggagacctgatcctcgagattggcaaactgcctcagcacctgacactccgggctcagaatgcccttgataacctggtgatgctgcacaattccgaacaagggggaaaggcgtacagacatgccatggaggaactccccgacaccatcgagacactgatgcttctggctctcattgccgttctgacgggcggcgtgaccctgtttttcctctctgggaagggacttggcaaaacaagcatcgggctgctgtgtgtgaccgcttcctctgccctcctgtggatggccagcgtcgagccgcactggatcgctgcgtccattatccttgaatttttcctgatggttctcctgattcctgagcccgatcggcaacgcacacctcaggacaaccagctggcctatgtggtgatcggactcctttttatgattctgaccgtcgctgccaacgaaatgggcctgctcgagacgaccaagaaagatctggggatcggacatgtggccgctgagaatcaccaacacgccacaatgcttgacgttgatctgagacccgcgagcgcctggaccctctacgctgtggccacaaccgtcatcacgcctatgatgcggcatacaattgaaaacaccacagctaatatctctctgaccgccattgcgaaccaggccgctatcctgatgggcctcgacaagggctggcccatttccaaaatggatatcggggtgccgcttctggccctgggatgctacagccaggtcaatcctctcaccctgacagctgccgtgcttatgctggttgctcactatgccattatcggccccgggctccaggcgaaggccacgcgcgaggctcaaaagagaaccgccgctggaatcatgaaaaaccccacagtggacggcattgtcgccatcgatctggaccctgtggtttacgacgccaagttcgaaaaacagctggggcagattatgctccttatcctgtgtacctctcagattctgctcatgcggacaacctgggcgctgtgcgagtccatcacgcttgctacaggaccgctgaccaccctctgggaaggcagccccggcaagttttggaatacaaccatcgccgtgtctatggctaacattttccgcgggagctatctggccggagccggcctggctttctccctcatgaaatctcttgggggaggcagacgggggacaggagcccaaggcgagacgctgggcgagaagtggaagcgccagctgaatcagctcagcaaatccgaatttaacacctacaagagaagcgggatcatggaggtcgatcggtccgaagcgaaagagggactgaagagaggcgaaacaaccaaacatgccgtgtctcgcgggacagctaaacttcggtggttcgtggagagaaatctggttaagcctgagggaaaagtcattgacctcggctgtgggcgcggaggctggagctattactgcgccggcctgaagaaagtgaccgaagtgaaggggtatacgaaaggaggccccgggcacgaggaacctatccccatggctacctacggatggaacctggtcaagctccattccggcaaagatgtgtttttcatgcctccggagaagtgtgacacacttctgtgcgatattggggaatctagccccaatcctaccatcgaggagggacggacactgagagttctcaagatggtggaaccctggctgcgcggcaaccagttttgtatcaaaattcttaatccttacatgccctccgtcgtggagaccctggaacaaatgcagcggaagcacggcgggatgctcgttagaaacccgctgtctcgcaatagcacacacgagatgtattgggtgtcctgcggaaccggcaacatcgtcagcgccgtgaacatgacgtctcggatgctgctcaatagattcacaatggcgcatcgcaaacctacctacgagcgggacgttgatctgggggccggaaccagacacgtggctgtcgaacccgaggtggccaaccttgacattatcggccagcgcattgaaaatatcaagaacgagcataaatccacatggcactatgatgaagacaatccctacaagacgtgggcttatcacgggagctacgaggtgaagccttctggatccgccagctctatggtcaacggcgttgtgagactgctcaccaaaccctgggatgtgattcctatggtcacacaaatcgctatgaccgacacaaccccgtttggccagcagcgggtgttcaaggagaaagttgacacacgcacccccagagccaagcgggggacgacccagatcatggaagtgacagcgaaatggctgtggggatttctttccagaaataagaagcctcggatttgtacccgcgaggagttcacaagaaaagtccggagcaacgccgctatcggcgccgtgtttgttgatgagaatcaatggaactccgctaaggaagccgtggaggacgagcgcttctgggatctggtccatagagaacgggagctccacaaacaggggaagtgcgctacctgcgtgtataatatgatgggaaaacgcgaaaagaagctgggcgagtttgggaaagcgaagggcagcagagctatttggtacatgtggctgggagcccggttcctcgagttcgaggccctgggctttatgaacgaggaccattggttctctcgcgaaaatagcctttccggggttgagggagaaggcctgcacaaactcgggtacatcctgagagatatttctaagatccccggaggcaacatgtatgctgacgatacggccgggtgggacacacggatcaccgaggatgaccttcagaatgaggctaaaattacagaaatcatggagcctgaacatgccctgctcgcgaccagcatttttaagctgacgtaccagaacaaagtggtccgcgtgcaaagacccgccaagaacggcaccgtcatggatgtgatctcccggcgcgaccagagaggatctggccaggttgggacatatggactgaataccttcacaaacatggaggtgcagctcattcggcaaatggaaagcgagggcatctttctgccgtccgagcttgaaacccctaatctggctgagagagtcctcgattggctggaaaagcacggggccgagcgccttaaacggatggctatctctggagacgactgtgtggtgaagcccattgatgacagattcgccacagcgctgaccgccctcaacgatatgggcaaagttcgcaaggacatccctcagtgggaacccagcaaagggtggaatgattggcaacaggtgcctttttgctcccaccatttccaccaactgattatgaaggacggccgggagatcgtcgtgccctgtagaaaccaggatgagctggttggacgcgctcgggtgagccagggcgccgggtggtctctcagagaaacggcttgcctgggaaagtcctacgcccaaatgtggcagcttatgtattttcatcgccgggacctgagactcgctgccaatgcgatttgtagcgccgtcccggtggattgggtccctacatctcgcaccacctggtccatccacgctcaccatcagtggatgacaaccgaggacatgctgagcgtgtggaaccgggtttggatcgaagagaatccctggatggaagataaaacacacgtgtcctcttgggaggaggtcccctaccttggcaagagagaagaccagtggtgcgggagcctgattggactcacggcccgggccacctgggctacaaacatccaagtggccattaatcaggttagacgcctgatcggcaacgagaattatctggactacatgacctccatgaaacggttcaagaacgaaagcgatcctgagggggcgctctggtga

SEQ ID NO: 18592 - RNA, 9879 nt, synthetic construct
  misc_feature 1..9879: note = derived and/or modified CDS sequence (opt5) from DENV-1__GU131958__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctccattccggcaaagatgtctttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgccgtcaacatgacctctcggatgctgctcaatagattcacgatggcgcatcgcaaacctacatttgagcgggacgtggatctgggggccggaaccagacacgttgctgtggaacccgaggtcgccaaccttgacatcattggccagcgcatcgaaaatatcaagaacgagcataaatccacctggcactacgatgaagacaatccctataagacatgggcttaccacgggagctatgaggtgaagccttctggatccgccagctctatggtgaacggcgtcgttagactgctcacgaaaccctgggatgtgattcctatggtgacccaaatcgctatgacagacaccacaccgttcggccagcagcgggtctttaaggagaaagtggacacccgcacacccagagccaagcgggggaccacgcagattatggaagttaccgcgaaatggctgtggggattcctttccagaaataagaagcctcggatctgtacacgcgaggaatttaccagaaaagtgcggagcaacgccgctattggcgccgtcttcgtggatgagaatcaatggaactccgctaaggaagccgttgaggacgagcgcttttgggatctggtgcatagagaacgggagctccacaaacaggggaagtgcgccacatgcgtctacaatatgatgggaaaacgcgaaaagaagctgggcgagttcgggaaagcgaagggcagcagagctatctggtatatgtggctgggagcccggttcctcgaatttgaggccctgggcttcatgaacgaggaccattggttttctcgcgaaaatagcctttccggggtggagggagaaggcctgcacaaactcgggtacatcctgagagatatttctaagatccccggaggcaacatgtacgctgacgataccgccgggtgggacacgcggattacagaggatgaccttcagaatgaggctaaaatcaccgatattatggaacctgagcatgccctgctcgcgacaagcatcttcaagctgacctatcagaacaaagttgtgcgcgtccaaagacccgccaagaacggcacggtgatggacgtcatctcccggcgcgatcagagaggatctggccaggtggggacctacggactgaatacatttaccaacatggaagttcagctcattcggcaaatggagagcgaaggcatcttcctgccgtccgagcttgagacacctaatctggctgaaagagtgctcgactggctggagaagcacggggccgaacgccttaaacggatggctatttctggagacgattgtgtcgtgaagcccatcgacgatagatttgccaccgcgctgacagccctcaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctggtgggacgcgctcgggttagccagggcgccgggtggtctctcagagagaccgcttgcctgggaaagtcctatgcccaaatgtggcagcttatgtacttccatcgccgggatctgagactcgctgccaatgcgatttgtagcgccgtgccggtcgactgggtgcctacgtctcgcacaacctggtccatccacgctcaccatcagtggatgaccacagaagatatgctgagcgtctggaaccgggtgtggattgaggaaaatccctggatggaggacaaaacccacgtttcctcttgggaagaggtgccctatcttggcaagagagaggaccagtggtgcgggagcctgatcggactcacagcccgggccacgtgggctaccaacattcaagtcgccatcaatcaggtgagacgcctgattggcaacgaaaattacctggattatatgacatccatgaaacggtttaagaacgagagcgaccctgaaggggcgctctggtga

SEQ ID NO: 18593 - RNA, 9879 nt, synthetic construct
  misc_feature 1..9879: note = derived and/or modified CDS sequence (opt5) from DENV-1__GQ868499__SS-prME
  source 1..9879: mol_type = other RNA
agcgtgacaatgctgctcatgctgcttcccacagctctggctttccacctcacgaccagaggaggggaacctcatatgatcgtctccaagcaggaacggggaaaatctctgctttttaagacaagcgccggagttaatatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggagggcaccgcagagagaagcggtctgtcgccctggctcctcatgtgggactcggcctggagacacgcaccgaaacgtggatgagctccgagggcgcctggaaacagattcagagagttgaaacatgggcccttcggcaccccgggttcaccgtgatcgccctgtttctcgcgcatgccattggaacatctatcacccaaaagggcatcattttcatcctgcttatgctggtcacccctagcatggctatgcgctgcgtggggattggaaacagagactttgttgagggcctctccggggccacatgggtggatgtcgtgctggagcacggaagctgtgtgacgaccatggctaagaataaacccacactggacatcgaactcctgaagaccgaggtcacaaaccctgccgttcttcggaaactgtgcattgaagcgaagatctctaataccacgacagattcccgctgtccgacccagggcgaggccaccctcgtggaagaacaagacgctaacttcgtgtgcagacggacatttgtcgatcgcggctgggggaatggatgtggcctgttcgggaaaggaagccttctgacctgcgccaagtttaagtgcgtgacaaaactcgagggcaagattgttcagtacgaaaacctgaaatattctgtgatcgtcacggtgcacaccggggaccaacatcaggttggaaatgagacaaccgaacacggcacaatcgctaccattacgccccaggcccctacctccgagatccagctgacagattacggcgccctcaccctggactgtagccccagaacagggcttgacttcaacgaaatggtgctgctcaccatgaaggagaaatcttggctggtccataagcaatggtttcttgatctgcctctcccctggacgtccggagctagcacatcccaggagacctggaatcggcaggacctgctggtgacattcaaaaccgcgcacgccaagaagcaagaagtcgtggttctcggctctcaggagggggctatgcacaccgccctgacaggagccacggaaattcagaccagcggcacaaccacaatctttgctgggcatcttaaatgccgcctgaagatggataaactcaccctgaagggcacgtcctatgtgatgtgtacaggcagcttcaaactggagaaggaagtcgccgagacccagcacggcaccgtgcttgttcaagtgaagtacgaggggacagacgcgccgtgcaaaattcctttctctacccaggatgaaaagggagtcacacagaacggcagactcatcacggctaatcccatcgtgaccgacaaagagaagcctgtgaacattgaaacagagccgccctttggggagtcctatatcgttgtcggagccggcgaaaaagccctgaagctgagctggttcaagaaagggtctagcattggcaagatgtttgaggctaccgcccggggagctagacgcatggccatcctcggcgatacagcgtgggacttcgggtccattggaggcgtgtttacctctgtggggaaactggtccatcaggtgttcggaacggcctacggcgttctttttagcggggtgtcctggaccatgaagatcggcatcggcattctgctcacatggctgggcctgaatagccggtctacctcccttagcatgacatgtatcgctgtcgggatggtgaccctctacctgggagttatggtgcaagccgattctggctgcgtcattaactggaaagggagagaactgaagtgtggatccggcatcttcgtgacaaacgaggttcacacctggacggaacagtataagtttcaggctgacagccctaaacgcctctccgccgcgattgggaaggcctgggaggagggcgtgtgcggaatccggtctgctacaagactggaaaatattatgtggaaacagatcagcaacgagcttaatcatatcctgctcgaaaacgatatgaagttcaccgtcgtggtgggcgacgccaatgggattctggctcaaggcaagaagatgatccgcccgcagcccatggagcacaaatactcctggaagtcttggggcaaggccaaaattatcggggccgacattcagaacaccacatttatcatcgatggacctgacacccccgaatgtcctgataatcagcgggcttggaacatttgggaggtcgaggactatggcttcggcatctttacgacaaatatttggctgaaacttagagatagctacacccaaatgtgcgaccaccgcctcatgtccgcggccatcaaagatagcaaggctgttcatgccgacatggggtattggattgaatctgagaaaaacgaaacatggaagctggcccgggcttccttcatcgaggtgaagacctgtacatggcccaaaagccacaccctgtggtctaatggagtgctcgaatccgagatgatcattccgaagatctacggcgggcctattagccagcataactatagacccggatacttcacgcagaccgccggcccttggcacctggggaaacttgagctggattttgacctctgcgaaggaacaaccgtcgtggttgatgagcactgcggcaatcgcggcccctctctgcggacaaccacggtgacagggaagatcattcatgaatggtgttgcagaagctgtaccctgcctccccttcggttccgcggagaggacggctgctggtacgggatggagatcagaccggtcaaagaaaaggaggaaaacctcgtgcggtccatggttagcgcgggatctggcgaggtggattcctttagcctggggatcctgtgtgcttccattatgatcgaagaggtcatgagatctcgctggagccggaagatgctcatgacaggaaccctggccgtgttccttctgctcattatgggccaactgacctggaaagacctgatcagactttgcattatggttggcgccaatgcttccgaccgcatggggatgggaacaacgtatctggccctcatggcgacctttaagatgagacctatgttcgctgtgggcctgctctttcggcgcctgacatctagagaggtccttctgctcaccatcgggctgagcctggtggcctcccttgaactgcccaactctctcgaggaactgggagatggcctcgccatggggattatgatgctgaaacttctgacagagttccagccccaccagctctggaccacgctgctgagccttacatttatcaagaccaccctgtccctcgactacgcttggaaaacaaccgccatggctctgagcatcgtgtctctcttccctctgtgtctttccacaacgagccagaagaccacatggctgccggtcctgctcggatcttttggctgcaagcccctgaccatgttccttattacagaaaacaaaatctggggccggaagtcctggcctctgaatgaggggattatggccatcggaattgttagcatcctcctgtcttccctcctgaaaaacgatgtgccccttgcgggccctctgatcgccgggggaatgctgattgcttgttatgtgatcagcggctccagcgccgacctctctctggagaaggtcgctgaagtgagctgggagcaagaagccgagcattccgggacctctcacaatattcttgttgaagtgcaggatgacggaacgatgaaaatcaaggatgaggagcgcgacgataccctgacaattctcctgaaagccaccctcctggctgtcagcggcgtgtaccccatgtccatccctgcgacactttttgtttggtatttctggcagaagaagaaacagagatctggcgtgctgtgggacacccccagcccgcctgaagtcgagcgggccgtgctggatgacgggatctaccgcattctccaaagaggactgcttggccggtcccaggtcggggtgggagttttccaggatggcgtgtttcatacaatgtggcacgtcacgcgcggggctgtgctgatgtatcagggaaagagactcgaaccctcttgggccagcgttaaaaaggacctgatctcctacggcggcgggtggcggttccaaggaagctggaacaccggcgaggaggtgcaggtcattgccgtggaacctgggaaaaatcccaagaacgtgcagacaaccccgggaacctttaagacacctgagggcgaagttggggctatcgccctcgacttcaaacccggaacgtctggctcccctattgtcaatagagagggcaagatcgtggggctgtacggaaacggcgtggtcaccacaagcgggacctatgtgtctgcgattgctcaagccaaagcctcccaggaaggaccccttcccgagatcgaggatgaagtttttaagaaacgcaatctgacaatcatggacctgcaccctggcagcgggaagacccggagatacctcccggctattgtgcgcgaggccatcaagcggaaactgagaacgcttattctggcgcccacacgcgtcgtggcttccgaaatggccgaggccctcaagggcatgcctatccggtatcagaccaccgctgttaaatctgaacatacaggaagagagattgtggatctgatgtgccacgccaccttcacaatgcgcctgctcagccccgtccgggtgcctaactacaatatgatcatcatggacgaggctcattttaccgatcccgcctccattgcggccagaggctatatcagcacgcgggttgggatgggagaagctgccgctattttcatgacagccacccctccgggctctgtggaggcctttccccagtccaacgctgtcatccaagacgaagaaagagatattcctgaaagaagctggaactctgggtacgactggatcacagatttccccggaaagaccgtgtggtttgtgcctagcatcaaatccggcaacgacattgcgaattgtcttcggaagaacgggaagcgcgtcatccagctgtctagaaaaacgttcgataccgagtatcagaagaccaaaaataatgactgggactacgttgtgaccacagatattagcgagatgggcgccaacttccgggctgacagagtgatcgatccccgccggtgcctgaagccggtcattctcaaagacggacctgaaagagtgatcctggccggccccatgcccgttaccgtggcctccgctgcccagcgccgggggagaattggacgcaatcaaaacaaggagggcgatcagtacgtctatatggggcagcctcttaataacgacgaagatcacgcgcattggacagaggctaagatgctgctcgacaatatcaacacccccgagggaatcattcctgccctgtttgaaccggagcgggaaaaatctgccgctatcgatggcgagtacagactgcgcggggaagccagaaagacgttcgtggagctcatgcggcgcggcgaccttcccgtttggctgagctataaagtggcgtccgagggatttcagtacagcgatagacggtggtgcttcgacggcgaacgcaataaccaagtcctggaggaaaatatggatgtggagatttggacaaaggaaggggagcgcaaaaagctccggcctagatggctggacgcccgcacctattctgacccccttgctctgcgggagtttaaagagttcgccgctggaagacgctccgtcagcggcgatctcatcctggagattgggaagctgcctcagcacctcacccttcgggcccagaacgctctggacaatctggtgatgctccacaactccgaacagggaggcaaggcctacagacatgcgatggaggaactgcccgatacaatcgagacccttatgctgctcgccctgatcgctgttctgacaggcggggtgacgctctttttcctttctggaaaaggcctggggaagaccagcattggactgctctgtgtgacagcctcctctgctctgctttggatggccagcgtcgagccgcactggatcgccgcttccattatcctggaatttttcctcatggttctgctgattcctgagcccgaccggcaacgcacccctcaggataatcagctcgcgtatgtggtgatcggccttctgtttatgatcctgacagtcgccgctaacgaaatggggctcctggagaccacgaaaaaggaccttggaattggccatgtggccgccgagaaccaccaacacgctaccatgctggatgttgacctcagacccgccagcgcgtggacactgtacgccgtggctaccacagtcatcacccctatgatgcggcatacgattgaaaatacaaccgccaacatctctctgacagctattgccaatcaggcggccatcctcatgggccttgataaagggtggcccatttccaagatggacatcggagtgccgctgctggctctcggctgctacagccaggtcaaccctctgacccttaccgccgctgtgctgatgctcgttgcccactatgctatcattgggcccggactgcaggccaaggcgacacgcgaggcccagaaaagaacggctgccggcatcatgaagaatcccaccgtggatgggattgtcgctatcgacctggatcctgtggtttacgacgccaaattcgaaaagcagctcggacagattatgcttctgatcctgtgtacatctcagatcctcctgatgcggaccacatgggccctttgcgagtccattaccctggcgacgggcccgctcacaaccctgtgggaaggcagccccgggaaattttggaacaccacaatcgctgtgtctatggccaatattttccgcggaagctatctggctggcgccgggctcgccttctcccttatgaagtctctgggaggcgggagacggggaaccggcgctcaaggcgagacactgggggagaagtggaaacgccagctcaaccagctgagcaagtccgaatttaatacgtacaaaagaagcggaatcatggaggtcgaccggtccgaagccaaggagggccttaaaagaggggaaaccacaaagcatgcggtgtctcgcggaaccgccaagctgcggtggttcgtggagagaaacctcgttaaacctgagggcaaggtcattgatctggggtgtggacgcggcggctggagctattactgcgctgggctgaaaaaggtgacagaagtgaaaggatataccaagggcgggcccggacacgaggaacctatccccatggccacgtacggctggaatctcgtcaaacttcattccgggaaggacgtgtttttcatgcctccggagaagtgtgataccctgctgtgcgacatcggagaatctagccccaaccctacaattgaggagggccggaccctcagagttctgaaaatggtggaaccctggcttcgcggcaatcagttttgtatcaagattctgaacccttacatgccctccgtcgtggagacactcgaacaaatgcagcggaaacacgggggaatgctggttagaaatccgctgtctcgcaacagcacccacgagatgtattgggtgtcctgcggcacagggaatatcgtcagcgctgtgaacatgacctctcggatgctcctgaacagattcacgatggcccatcgcaagcctacatacgagcgggatgttgaccttggagcgggcaccagacacgtggccgtcgaacccgaggtggctaatctggatattatcgggcagcgcattgaaaacatcaaaaatgagcataagtccacctggcactatgacgaagataacccctacaagacatgggcctatcacggaagctacgaggtgaaaccttctggctccgctagctctatggtcaatggcgttgtgagactcctgacgaagccctgggacgtgatccctatggtcacccaaattgccatgacagataccacaccgtttgggcagcagcgggtgttcaaagagaaggttgacacccgcacacccagagctaaacggggaaccacgcagatcatggaagtgaccgccaagtggctttggggctttctgtccagaaacaagaaacctcggatttgtacacgcgaggagttcaccagaaaggtccggagcaatgcggccatcggggctgtgtttgttgacgagaaccaatggaactccgccaaagaagctgtggaggatgagcgcttctgggacctcgtccatagagaacgggagctgcacaagcagggaaaatgcgccacatgcgtgtataacatgatgggcaagcgcgaaaagaaactgggggagtttggcaaggccaaaggaagcagagcgatttggtacatgtggctcggcgctcggttcctggagttcgaggcccttgggtttatgaatgaggatcattggttctctcgcgaaaacagcctgtccggagttgagggcgaagggctccacaagctgggatacatccttagagacatctctaaaattcccggcgggaatatgtatgccgatgacaccgctggctgggatacgcggatcacagaggacgatctgcagaacgaggccaagattaccgacatcatggaacctgagcatgctctcctggccacaagcatttttaaactgacctaccagaataaggtggtccgcgtgcaaagacccgcgaagaacggaacggtcatggatgtgatctcccggcgcgaccagagaggctctgggcaggttggaacctatggcctcaacacattcaccaatatggaagtgcagctgatccggcaaatggagagcgaagggatttttcttccgtccgagctggagacacctaacctcgccgaaagagtcctggattggcttgagaaacacggagctgaacgcctgaagcggatggccatctctggcgacgactgtgtggtgaaacccattgatgacagattcgctaccgccctcacagcgctgaatgatatggggaaggttcgcaaagacatccctcagtgggagcccagcaagggctggaacgattggcaacaggtgcctttttgctcccaccatttccaccaactgattatgaaggacggacgggaaatcgtcgtgccctgtagaaatcaggatgagctcgttggccgcgcccgggtgagccagggggctggatggtctctgagagagaccgcctgccttggcaaatcctacgctcaaatgtggcagctgatgtattttcatcgccgggacctcagactggccgctaacgccatctgtagcgcggtcccggtggattgggtccctacgtctcgcacaacctggtccattcacgcccaccatcagtggatgaccacagaagacatgcttagcgtgtggaatcgggtttggatcgaggaaaacccctggatggaggataagacccacgtgtcctcttgggaagaggtcccctacctggggaaaagagaggaccagtggtgcggaagcctcattggcctgacagctcgggccacgtgggccaccaatatccaagtggctattaaccaggttagacgcctgatcgggaatgaaaactatctcgactacatgacatccatgaagcggttcaaaaatgagagcgatcctgaaggcgccctgtggtga

SEQ ID NO: 18594 - RNA, 9879 nt, synthetic construct
  misc_feature 1..9879: note = derived and/or modified CDS sequence (opt5) from DENV-1__GQ868500__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaagctgccgaagtgagctgggagcaagaagccgagcattccggcacctctcacaacattctggttgaagtgcaggacgatgggacgatgaagatcaaagacgaggagcgcgatgacacccttacaattctgctcaaggctaccctgctcgcggtcagcggagtgtaccccatgtccatccctgccacactgtttgtttggtatttctggcagaaaaagaagcagagatctggcgtgctttgggatacccccagcccgcctgaagtcgagcgggctgtgctggacgatggcatctaccgcattctgcaaagagggctcctgggacggtcccaggtcggcgtgggggttttccaggacggagtgtttcatacaatgtggcacgtcacgcgcggcgccgtgcttatgtatcaggggaaaagactggaaccctcttgggccagcgttaagaaagacctcatctcctacggaggcggctggcggttccaagggagctggaataccggagaggaggtgcaggtcattgctgtggaacctggcaagaaccccaaaaatgtgcagacaaccccggggacctttaagacacctgagggagaagttggcgccatcgcgctggatttcaagcccgggacgtctggatcccctattgtcaacagagagggcaaaatcgtgggcctctacgggaatggagtggtcaccacaagcggcacctatgtgtctgctattgcccaagccaaggcttcccaggaagggcccctgcccgagatcgaggacgaagtttttaaaaagcgcaaccttacaatcatggatctgcaccctggaagcggcaaaacccggagatacctgccggccatggtgcgcgaggcgattaagcggaagctcagaacgctgatccttgctcccacacgcgtcgtggcctccgaaatggccgaggctctgaaagggatgcctattcggtatcagaccaccgccgttaagtctgaacatacaggcagagagatcgtggacctcatgtgccacgctaccttcacaatgcgcctgctgagccccgtccgggtgcctaattacaacatgattatcatggatgaggcccattttaccgaccccgcgtccatcgccgctagaggatatattagcacgcgggttggcatgggggaagccgctgccatcttcatgacagccacccctccgggatctgtggaggcttttccccagtccaatgcggtcattcaagatgaagagcgcgacatccctgaaagaagctggaactctggctacgattggattacagacttccccgggaaaaccgtgtggtttgtgcctagcatcaagtccggaaatgatatcgccaactgtctccggaaaaacggcaagcgcgtcattcagctttctagaaagacgttcgacaccgagtatcagaaaacaaagaataacgactgggattacgttgtgaccacagacatcagcgagatgggggctaatttccgggccgatagagtgattgacccccgccggtgcctgaaaccggtcatcctgaaggatggccctgaaagagtgattctcgccggacccatgcccgttaccgtggcttccgccgcgcagcgccggggcagaatcgggcgcaaccaaaataaagagggagaccagtacgtctatatgggccagcctctgaacaatgatgaagaccacgctcattggacagaggccaagatgcttctggataacattaatacccccgaggggatcatccctgccctctttgaaccggagcgggaaaagtctgctgccattgacggagagtacagactgcgcggcgaagcgagaaaaacgttcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatctggacaaaagaaggcgagagaaagaaactgcggcctagatggctcgacgctcgcacctattctgatcccctggcccttcgggagtttaaggaattcgctgccgggagacgctccgtcagcggagacctgattctcgagatcggcaaactgcctcagcacctgaccctccgggctcagaatgcccttgataacctggtgatgctgcacaattccgaacaggggggaaaggcgtacagacatgccatggaggaactccccgacacaattgagaccctgatgcttctggctctcatcgccgttctgacaggcggcgtgacgctgtttttcctctctgggaagggacttggcaaaaccagcatcgggctgctgtgtgtgacagcttcctctgccctcctgtggatggccagcgtcgagccgcactggattgctgcgtccatcattcttgaatttttcctgatggttctcctgatccctgagcccgatcggcaacgcacccctcaggacaaccagctggcctatgtggtgattggactcctttttgtcatcctgacagtggctgccaacgaaatgggcctgctcgagaccacgaagaaagatctggggatcggacatgttgccgctgagaatcaccaacacgccaccatgcttgacgtggatctgagacccgcgagcgcctggacactctacgctgtcgccaccacagtgattacccctatgatgcggcatacgatcgaaaacacaaccgctaatatttctctgacagccatcgcgaaccaggccgctattctgatgggcctcgacaagggctggcccatctccaaaatggatattggggtcccgcttctggccctgggatgctacagccaggtgaatcctctcaccctgaccgctgccgttcttatgctggtggctcactatgccatcatcggccccgggctccaggcgaaggccacacgcgaggctcaaaagagaacggccgctggaattatgaaaaaccccaccgtcgacggcatcgtggccattgatctggaccctgttgtgtacgacgccaagttcgaaaaacagctggggcagatcatgctccttattctgtgtacatctcagatcctgctcatgcggaccacatgggcgctgtgcgagtccatcacccttgctacgggaccgctgacaaccctctgggaaggcagccccggcaagttttggaataccacaattgccgtctctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtgtctcgcgggaccgctaagcttcggtggttcgttgagagaaatctggtcaagcctgagggaaaagtgatcgacctcggctgtgggcgcggaggctggagctattactgcgccggcctgaagaaagtgacagaagtcaaggggtataccaaaggaggccccgggcacgaggaacctattcccatggctacgtacggatggaacctggttaagctccattccggcaaagatgtgtttttcatgcctccggagaagtgtgacacccttctgtgcgatatcggggaatctagccccaatcctacaatcgaggagggacggaccctgagagtgctcaagatggtcgaaccctggctgcgcggcaaccagttttgtattaaaatccttaatccttacatgccctccgtggttgagacactggaacaaatgcagcggaagcacggcgggatgctcgtgagaaacccgctgtctcgcaatagcacccacgagatgtattgggtctcctgcggaacaggcaacattgtgagcgccgttaacatgacctctcggatgctgctcaatagattcacgatggcgcatcgcaaacctacatacgagcgggacgtggatctgggggccggaaccagacacgtcgctgtggaacccgaggtggccaaccttgacatcattggccagcgcatcgaaaatattaagaacgagcataaatccacctggcactatgatgaagacaatccctacaagacatgggcttatcacgggagctacgaggtcaagccttctggatccgccagctctatggttaacggcgtggtgagactgctcacgaaaccctgggatgtcatccctatggtgaagcaaatcgctatgaccgacacaaccccgtttggccagcagcgggttttcaaagagaaggtggacacacgcacccccagagccaaacgggggacaacccagattatggaagtcacggcgaagtggctgtggggatttctttccagaaataagaaacctcggatctgtacccgcgaggaattcacaagaaaggtgcggagcaacgccgctattggcgccgtttttgtgggggagaatcaatggaactccgctaaagaagccgtcgaggatgagcgcgtgtgggacctggttcatagagaacgggagctccacaagcagggaaaatgcgccacctgcgtgtataatatgatgggcaagcgcgaaaagaaactgggggagttcggcaaggcgaaaggaagcagagctatctggtacatgtggctgggcgcccggtttctcgaattcgaggccctggggttcatgaacgaggatcattggttttctcgcgaaaatagcctttccggagtcgagggcgaagggctgcacaagctcggatacattctgagagacatctctaaaatccccggcgggaacatgtatgctgatgacacagccggctgggatacccggattacggaggacgatcttcagaatgaggctaagatcacagaaattatggagcctgaacatgccctgctcgcgaccagcatcttcaaactgacataccagaacaaggtggtccgcgtgcaaagacccgccaagaacggaaccgttatggacgtgatttcccggcgcgatcagagaggctctgggcaggtcggaacgtatggcctgaatacctttacaaacatggaggtgcagctcatccggcaaatggaaagcgaggggatcttcctgccgtccgagcttgaaacccctaatctggctgagagagtgctcgactggctggaaaaacacggagccgagcgccttaagcggatggctatttctggcgatgactgtgttgtgaaacccatcgacgatagatttgccacagcgctgaccgccctcaacgacatggggaaggtccgcaaagatattcctcagtgggaacccagcaagggctggaatgactggcagcaggtgcctttctgctcccaccattttcaccaactgatcatgaaggatggacgggagattgttgtgccctgtagaaaccaggacgagctggtcggccgcgctcgggtgagccagggggccggatggtctctcagagaaacagcttgcctgggcaaatcctacgcccaaatgtggcagcttatgtatttccatcgccgggatctgagactcgctgccaatgcgatctgtagcgccgtcccggtggactgggttcctacctctcgcacgacatggtccatccacgctcaccatcagtggatgaccaccgaggatatgctgagcgtgtggaaccgggtctggattgaagagaatccctggatggaagacaagacacacgtgtcctcttgggaggaggttccctaccttgggaaaagagaagatcagtggtgcggaagcctgatcggcctcaccgcccgggccacatgggctacgaacattcaagtggccatcaatcaggtcagacgcctgattgggaacgagaattatctggactacatgacctccatgaagcggtttaaaaacgaaagcgaccctgagggcgcgctctggtga

SEQ ID NO: 18595 - RNA, 9879 nt, synthetic construct
  misc_feature 1..9879: note = derived and/or modified CDS sequence (opt5) from DENV-1__GU131961__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcagactggagaaagaagtggccgagacccagcacggaaccgtccttgtgcaagttaagtacgagggcacagatgcgccgtgcaagatccctttctctacccaggacgaaaaaggggtgacacagaacggacggctcatcacggctaatcccattgtcaccgataaggagaaacctgtgaacatcgaaacagagcccccctttggcgagtcctatattgtggttggggccggagaaaaggccctgaaactgagctggttcaagaagggctctagcatcgggaaaatgtttgaggctaccgccagaggcgctcgccggatggccattctcggagacacagcgtgggatttcggctccatcgggggagtctttacctctgtgggcaagctggtgcatcaggtcttcgggacggcctacggagtgctttttagcggcgtttcctggaccatgaaaatcgggattggcatcctgctcacatggctgggactgaatagcagatctacctcccttagcatgacatgtattgctgtgggcatggtcaccctctacctgggggtgatggttcaagccgactctggatgcgtgatcaactggaagggccgcgaactgaaatgtgggtccggaattttcgtcacaaacgaggtgcacacctggacggaacagtataagtttcaggctgatagccctaagcggctctccgccgcgatcggcaaagcctgggaggagggggtttgcggcattagatctgctacacgcctggaaaatatcatgtggaagcagatcagcaacgagcttaatcatattctgctcgaaaacgacatgaaattcaccgtggtcgtgggagacgccaatggcatcctggctcaagggaagaaaatgattcggccgcagcccatggagcacaagtactcctggaaatcttggggaaaggccaagatcattggcgccgatatccagaacaccacatttatcattgacgggcctgatacccccgaatgtcctgacaatcagagagcttggaacatctgggaggtggaggattatggattcggcatttttacgacaaatatctggctgaaacttcgcgacagctacacccaaatgtgcgatcaccggctcatgtccgcggccattaaggacagcaaagctgtccatgccgatatgggctattggatcgaatctgagaagaacgaaacatggaaactggccagagcttccttcatcgaggttaagacctgtacatggcccaagagccacaccctgtggtctaatggggtgctcgaatccgagatgattatcccgaaaatttacggaggccctatcagccagcataactatcgccccgggtacttcacgcagaccgccggaccttggcacctgggcaagcttgagctggactttgatctctgcgaagggacaaccgtggtcgtggacgagcactgcggaaatcggggcccctctctgagaacaaccacggttacaggcaaaattatccatgaatggtgttgccggagctgtaccctgcctccccttcgcttcagaggggaggatggatgctggtacggcatggagatccggccggtgaaggaaaaagaggaaaacctcgtcagatccatggtgagcgcggggtctggagaggttgactcctttagcctgggcattctgtgtgcttccatcatgattgaagaggtgatgcgctctcggtggagcagaaagatgctcatgacagggaccctggccgtcttccttctgctcatcatgggacaactgacctggaatgacctgattcgcctttgcatcatggtgggcgccaacgcttccgatagaatgggcatggggacaacgtatctggccctcatggcgacctttaagatgcggcctatgttcgctgttggactgctctttcgcagactgacatctcgggaggtgcttctgctcaccattggcctgagcctggtcgcctccgtggaacttcccaactctctggaggaactcggggacggactggccatgggcatcatgatgctcaaactgcttacagagttccagccccaccagctgtggaccacgctcctgagcctgacatttatcaagaccaccctttccctggattacgcttggaaaacaaccgccatggctctcagcattgtgtctctgttccctctctgtctgtccacaacgagccagaagaccacatggcttccggtcctgctggggtcttttggatgcaaacccctcaccatgttcctgatcacagaaaataagatttggggccgcaagtcctggcctcttaacgagggcatcatggccattgggatcgttagcatcctgctctcttccctgctcaaaaatgacgtgcccctggcgggacctcttattgccggcgggatgctgatcgcttgttatgtgattagcggatccagcgccgatctgtctctcgagaaggctgccgaagtcagctgggagcaagaagccgagcattccggcacctctcacaacatcctggtggaagttcaggacgatgggacgatgaaaattaaggacgaggagagagatgacacccttacaatcctgctcaaagctaccctgctcgcggtgagcggagtctaccccatgtccatccctgccacactgtttgtgtggtatttctggcagaagaaaaagcagcggtctggcgttctttgggatacccccagcccgcctgaagtggagcgcgctgtcctggacgatggcatttacagaatcctgcaacgggggctcctgggacgctcccaggtgggcgtcggggtgttccaggacggagtttttcatacaatgtggcacgtgacgagaggcgccgtccttatgtatcaggggaagcggctggaaccctcttgggccagcgtgaaaaaggacctcatttcctacggaggcggctggagattccaagggagctggaataccggagaggaggttcaggtgatcgctgtcgaacctggcaaaaaccccaagaatgtgcagacaaccccggggacctttaaaacacctgagggagaagtgggcgccattgcgctggatttcaagcccgggacgtctggatcccctatcgttaaccgcgagggcaagattgtcggcctctacgggaatggagtggtgaccacaagcggcacctatgtctctgctatcgcccaagccaaagcttcccaggaagggcccctgcccgagatcgaggacgaagtgtttaagaaacggaaccttacaattatggatctgcaccctggaagcggcaagaccagacgctacctgccggccatcgttcgggaggcgattaaaagaaagctccgcacgctgatccttgctcccacacgggtggtcgcctccgaaatggccgaggctctgaaggggatgcctattagatatcagaccaccgccgtgaaatctgaacatacaggccgcgagatcgttgacctcatgtgccacgctaccttcacaatgcggctgctgagccccgtgagagtccctaattacaacatgatcattatggatgaggcccattttaccgaccccgcgtccatcgccgctcggggatatattagcacgcgcgtgggcatgggggaagccgctgccatcttcatgacagccacccctccgggatctgttgaggcttttccccagtccaatgcggtgattcaagatgaagagagagacatccctgaacggagctggaactctggctacgattggatcacagacttccccgggaagaccgtctggtttgtgcctagcattaaatccggaaatgatatcgccaactgtctccgcaagaacggcaaaagagtgattcagctttctcggaagacgttcgacaccgagtatcagaagacaaaaaataacgactgggattacgtcgttaccacagacatcagcgagatgggggctaatttcagagccgatcgcgtgattgacccccggagatgcctgaagccggtgatcctgaaagatggccctgaacgcgtcattctcgccggacccatgcccgtgaccgttgcttccgccgcgcagcggagaggccgcatcgggcggaaccaaaataaggagggagaccagtacgtgtatatgggccagcctctgaacaatgatgaagaccacgctcattggacagaggccaaaatgcttctggataacatcaatacccccgaggggattatccctgccctctttgaaccggagagagaaaagtctgctgccattgacggagagtaccgcctgagaggcgaagcgcggaagacgttcgtcgagctgatgcgcagaggggatctccccgtgtggcttagctataaagttgcctccgagggctttcagtacagcgaccggcgctggtgcttcgatggagaaagaaacaatcaagtgctggaggaaaacatggacgtcgagatctggacaaaggaaggcgagcggaaaaagctgagacctcgctggctcgacgctcggacctattctgatcccctggcccttagagagtttaaagaattcgctgccgggcgccggtccgtgagcggagacctgattctcgagatcggcaagctgcctcagcacctgaccctcagagctcagaatgcccttgataacctggtcatgctgcacaattccgaacaggggggaaaagcgtaccggcatgccatggaggaactccccgacacaatcgagaccctgatgcttctggctctcattgccgtgctgacaggcggcgttacgctgtttttcctctctgggaagggacttggcaagaccagcatcgggctgctgtgtgtgacagcttcctctgccctcctgtggatggccagcgtggagccgcactggattgctgcgtccatcattcttgaatttttcctgatggtcctcctgatccctgagcccgatcgccaaagaacccctcaggacaaccagctggcctatgttgtgatcggactcctttttatgattctgacagtggctgccaacgaaatgggcctgctcgagaccacgaaaaaggatctggggatcggacatgtcgccgctgagaatcaccaacacgccaccatgcttgacgtggatctgcggcccgcgagcgcctggacactctacgctgttgccaccacagtgattacccctatgatgcgccatacgatcgaaaacacaaccgctaatatttctctgacagccatcgcgaaccaggccgctattctgatgggcctcgacaaaggctggcccatctccaagatggatatcggggtcccgcttctggccctgggatgctacagccaggtgaatcctctcaccctgaccgctgccgtccttatgctggtggctcactatgccattatcggccccgggctccaggcgaaagccacaagagaggctcaaaagcggacggccgctggaattatgaagaaccccaccgttgacggcatcgtggccattgatctggaccctgtcgtgtacgacgccaaattcgaaaagcagctggggcagatcatgctccttatcctgtgtacatctcagattctgctcatgcgcaccacatgggcgctgtgcgagtccatcacccttgctacgggaccgctgacaaccctctgggaaggcagccccggcaaattttggaataccacaattgccgtttctatggctaacatcttcagagggagctatctggccggagccggcctggctttctccctcatgaagtctcttgggggaggccggcgcgggaccggagcccaaggcgagacactgggcgagaaatggaagagacagctgaatcagctcagcaagtccgaatttaacacgtacaaacggagcgggattatggaggtggatagatccgaagcgaaggagggactgaaacgcggcgaaaccacaaagcatgccgtctctcgggggaccgctaaacttagatggttcgtggagcgcaatctggtgaagcctgagggaaaggttatcgacctcggctgtgggcggggaggctggagctattactgcgccggcctgaaaaaggtcacagaagtgaaagggtataccaagggaggccccgggcacgaggaacctatccccatggctacgtacggatggaacctggtgaaactccattccggcaaggatgtctttttcatgcctccggagaaatgtgacacccttctgtgcgatattggggaatctagccccaatcctacaatcgaggagggaagaaccctgcgcgttctcaagatggtggaaccctggctgcggggcaaccagttttgtattaagatccttaatccttacatgccctccgtggtcgagacactggaacaaatgcagagaaaacacggcgggatgctcgtgcgcaacccgctgtctcggaatagcacccacgagatgtattgggtttcctgcggaacaggcaacattgtgagcgccgtcaacatgacctctagaatgctgctcaatcgcttcacgatggcgcatcggaagcctacatttgagagagacgtggatctgggggccggaacccgccacgttgctgtggaacccgaggtcgccaaccttgacatcattggccagagaatcgaaaatatcaaaaacgagcataagtccacctggcactacgatgaagacaatccctataaaacatgggcttaccacgggagctatgaggtgaagccttctggatccgccagctctatggtgaacggcgtcgttcggctgctcacgaagccctgggatgtgattcctatggtgacccaaatcgctatgacagacaccacaccgttcggccagcagcgcgtctttaaagagaaggtggacaccagaacaccccgggccaaaagagggaccacgcagattatggaagttaccgcgaagtggctgtggggattcctttcccggaataaaaagcctcgcatctgtacaagagaggaatttacccggaaggtgcgcagcaacgccgctattggcgccgtcttcgtggatgagaatcaatggaactccgctaaagaagccgttgaggacgagagattttgggatctggtgcatcgggaacgcgagctccacaagcaggggaaatgcgccacatgcgtctacaatatgatgggaaagagagaaaaaaagctgggcgagttcgggaaggcgaaaggcagccgggctatctggtatatgtggctgggagcccgcttcctcgaatttgaggccctgggcttcatgaacgaggaccattggttttctagagaaaatagcctttccggggtggagggagaaggcctgcacaagctcgggtacatcctgcgggatatttctaaaatccccggaggcaacatgtacgctgacgataccgccgggtgggacacgcgcattacagaggatgaccttcagaatgaggctaagatcaccgatattatggaacctgagcatgccctgctcgcgacaagcatcttcaaactgacctatcagaacaaggttgtgagagtccaacggcccgccaaaaacggcacggtgatggacgtcatctcccgcagagatcagcggggatctggccaggtggggacctacggactgaatacatttaccaacatggaagttcagctcattagacaaatggagagcgaaggcatcttcctgccgtccgagcttgagacacctaatctggctgaacgcgtgctcgactggctggagaagcacggggccgaacggcttaagagaatggctatttctggagacgattgtgtcgtgaaacccatcgacgatcgctttgccaccgcgctgacagccctcaacgacatgggcaaggtgcggaaagatattcctcagtgggagcccagcaaggggtggaatgactggcagcaggttcctttctgctcccaccattttcaccaactgatcatgaaagatggcagagaaatcgtggtcccctgtcgcaaccaggacgagctggtgggacgggctagagttagccagggcgccgggtggtctctccgcgagaccgcttgcctgggaaagtcctatgcccaaatgtggcagcttatgtacttccatcggagagatctgcgcctcgctgccaatgcgatttgtagcgccgtgccggtcgactgggtgcctacgtctcggacaacctggtccatccacgctcaccatcagtggatgaccacagaagatatgctgagcgtctggaacagagtgtggattgaggaaaatccctggatggaggacaagacccacgtttcctcttgggaagaggtgccctatcttggcaaacgggaggaccagtggtgcgggagcctgatcggactcacagccagagccacgtgggctaccaacattcaagtcgccatcaatcaggtgcgccggctgattggcaacgaaaattacctggattatatgacatccatgaagagatttaaaaacgagagcgaccctgaaggggttctctggtga

SEQ ID NO: 18596 - RNA, 9870 nt, synthetic construct
  misc_feature 1..9870: note = derived and/or modified CDS sequence (opt5) from DENV-1__GU131962__SS-prME
  source 1..9870: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagtctgaacatacaggcagagagattgtcgacctcatgtgccacgccaccttcacaatgcgcctgctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctccggaaaaacggcaagcgcgttatccagctttctagaaagacgttcgacaccgagtatcagaaaacaaagaataacgactgggattacgtggtgaccacagacattagcgagatgggggccaatttccgggctgatagagtcatcgacccccgccggtgcctgaaaccggtgattctgaaggatggccctgaaagagttatcctcgccggacccatgcccgtgaccgtcgcctccgctgcccagcgccggggcagaattgggcgcaaccaaaataaagagggagaccagtacgtgtatatgggccagcctctgaacaatgatgaagaccacgcgcattggacagaggctaagatgcttctggataacatcaatacccccgaggggatcattcctgccctctttgaaccggagcgggaaaagtctgccgctatcgacggagagtacagactgcgcggcgaagccagaaaaacgttcgttgagctgatgcggcgcggggatctccccgtgtggcttagctataaggtcgcgtccgagggctttcagtacagcgacagacggtggtgcttcgatggagaacgcaacaatcaagtgctggaggaaaacatggacgtcgagatttggacaaaagaaggcgagagaaagaaactgcggcctagatggctcgacgcccgcacctattctgatcccctggctcttcgggagtttaaggaattcgccgctgggagacgctccgtgagcggagacctgatcctcgagattggcaaactgcctcagcacctgaccctccgggcccagaatgctcttgataacctggttatgctgcacaattccgaacaggggggaaaggcctacagacatgcgatggaggaactccccgacacaatcgagaccctgatgcttctggccctcatcgctgtgctgacaggcggcgtgacgctgtttttcctctctgggaagggacttggcaaaaccagcattgggctgctgtgtgtcacagcctcctctgctctcctgtggatggccagcgttgagccgcactggatcgccgcttccattatccttgaatttttcctgatggtgctcctgattcctgagcccgatcggcaacgcacccctcaggacaaccagctggcgtatgtggtcatcggactcctttttatgatcctgacagtggccgctaacgaaatgggcctgctcgagaccacgaagaaagatctggggattggacatgttgccgccgagaatcaccaacacgctaccatgcttgacgtggatctgagacccgccagcgcgtggacactctacgccgtcgctaccacagtgatcacccctatgatgcggcatacgattgaaaacacaaccgccaatatctctctgacagctattgccaaccaggcggccatcctgatgggcctcgacaagggctggcccatttccaaaatggatatcggggtcccgcttctggctctgggatgctacagccaggtgaatcctctcaccctgaccgccgctgttcttatgctggtggcccactatgctatcattggccccgggctccaggccaaggcgacacgcgaggcccaaaagagaacggctgccggaatcatgaaaaaccccaccgtcgacggcattgtggctatcgatctggaccctgttgtgtacgacgccaagttcgaaaaacagctggggcagattatgctccttatcctgtgtacatctcagatcctgctcatgcggaccacatgggccctgtgcgagtccattacccttgcgacgggaccgctgacaaccctctgggaaggcagccccggcaagttttggaataccacaatcgctgtctctatggccaacattttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggatcatggaggtggatcggtccgaagccaaagagggactgaagagaggcgaaaccacaaaacatgcggtgtctcgcgggaccgccaagcttcggtggttcgttgagagaaatctggtcaagcctgagggaaaagtgattgacctcggctgtgggcgcggaggctggagctattactgcgctggcctgaagaaagtgacagaatatgcctccgctgggctggccatcatcgtccccctccctcttgatacctacggacggaacagactgaagattcactctggcaaagacgtttttttcatgccccctgagaagggggatacgctgctctgtgacatcggagaaagctccccgaatcccaccattgaggaaggccgcacactgcgggtgcttaaaatggtggagccttggctgagagggaaccagttttgcatcaagattctcaatccctacatgccttctgtcgtggaggcgctggaacaaatgcagcgcaagcatggaggcatgctggttcggaaccccctcagcagaaattccacccacgagatgtattgggtgagctgtggcacagggaacatcgtctctgccgtgaacatgacctcccgcatgctgcttaatcggttcacaatggctcacagaaaaccgacctacgaacgcgatgttgacctgggagccggcacgagacatgtggctgtcgagcctgaggtggccaacctcgatattatcgggcagcggatcgaaaatattaagaacgagcacaaaagcacatggcattatgacgaagataatccctacaagacctgggcttatcacggatcttacgaggtgaaaccctccggcagcgcctcttccatggtcaacggggttgtgcgcctgcttaccaagccttgggacgtgatccccatggtcacacaaattgcgatgacggacaccacaccttttggacagcagagagtgttcaaggaaaaagttgatacccggacaccgagagccaagcggggcaccacacagatcatggaggtgaccgctaaatggctgtggggctttctcagccgcaataagaaacccagaatttgcacgcgggaggaattcacccgcaaggtcagatccaacgccgctatcggggccgtgtttgttgacgagaatcaatggaacagcgccaaggaagcggtggaggatgaacggttctgggacctggtccaccgcgagagagagctgcataaacagggaaagtgtgctacatgcgtgtataatatgatgggcaaacgggaaaagaaactcggggagtttggaaaggccaagggctctcgcgccatctggtacatgtggctgggggctagattccttgaattcgaggccctgggctttatgaacgaagatcactggttcagccgggagaattccctctctggagttgagggcgaagggctgcataaacttggatacattctgcgcgacatcagcaagattcctggcgggaacatgtatgctgatgacaccgccggatgggatacaagaatcaccgaggacgatctccagaatgaagcgaaaattacggagatcatggagcccgaacacgccctgctggctacatccatctttaagctcacctaccagaacaaagtggtccgggtgcaacgccctgccaagaacggcacagtcatggacgtgatttctagacgggatcagagagggagcggccaggttggaacctatggcctgaatacgttcaccaacatggaggtgcagcttatccgccaaatggaatccgaggggatttttctgccctctgaactcgagacaccgaatctggctgagcgggtccttgactggctggaaaaacatggagccgagagactcaagcgcatggcgatcagcggcgacgattgcgtggtgaagcctattgacgatcggttcgccaccgctctgacagccctgaacgacatggggaaagttagaaaggatatcccccagtgggaaccttccaaaggatggaatgactggcagcaggtgcccttttgtagccaccacttccatcaactcatcatgaaggatggccgcgagattgtcgtgccttgccggaaccaggacgaactggttgggagagctcgcgtgtctcagggcgccggatggtcccttcgggagaccgcttgtctgggcaaaagctacgcccaaatgtggcagctcatgtattttcacagacgcgatctgcggcttgcggccaatgctatctgctctgccgtccccgtggactgggtcccgacatccagaaccacgtggagcattcatgcccaccaccagtggatgacaaccgaggatatgctgtccgtgtggaaccgggtttggatcgaagagaatccttggatggaagacaagacccatgtgtctagctgggaggaagtcccctacctcgggaagagagaggaccagtggtgtggatccctgattggcctgacagctcgcgccacctgggcgacaaacatccaagtggctattaatcaggttcggagactcatcgggaacgagaattatctggattacatgacgagcatgaaacgcttcaagaacgaatctgaccccgagggagccctttggtga

SEQ ID NO: 18597 - RNA, 9879 nt, synthetic construct
  misc_feature 1..9879: note = derived and/or modified CDS sequence (opt5) from DENV-1__GU131963__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgcctttttcctggcgcatgccattgggacatctatcacccaaaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaagaataaacccacactggatatcgaactgctcaagaccgaggtcacaaaccctgccattctgcggaaactttgcatcgaagcgaagatttctaataccacgacagactcccgctgtccgacccagggagaggccaccctggttgaagagcaggatgctaactttgtgtgcagacggacattcgtggaccgcggctggggcaatgggtgtggactctttggcaaagggagcctgcttacctgcgccaagttcaagtgcgtcacaaaactggagggaaagatcgtgcagtacgaaaacctcaaatattctgttatcgtgacggtccacaccggcgatcaacatcaggtggggaatgagacaaccgaacacggaacaattgctaccatcacgccccaggcccctacctccgagattcagctgacagactacggcgccctgaccctcgactgtagccccagaacaggcctggattttaacgaaatggttcttctgaccatgaaggagaaatcttggctcgtgcataagcaatggttcctggaccttcctctgccctggacgtccggggctagcacatcccaggagacctggaatcggcaggatctcctggtcacatttaaaaccgcgcacgccaagaagcaagaagtggtcgtgctgggatctcaggagggcgctatgcacaccgccctcacaggggccacggaaatccagaccagcggaacaaccacaattttcgctggccatctgaaatgccgccttaagatggacaaactgaccctcaaggggacgtcctatgttatgtgtacaggcagcttcaaactggagaaggaagtggccgagacccagcacggaaccgtcctggtgcaagttaagtacgagggcacagatgcgccgtgcaaaatccctttttctacccaggacgaaaagggggtgacacagaacggaagacttatcacggctaatcccattgtcaccgataaagagaagcctgtgaacatcgaaacagagccccccttcggcgagtcctatattgtggttggggccggagaaaaagccctcaagctgagctggtttaagaaaggctctagcatcgggaagatgttcgaggctaccgcccggggcgctagacgcatggccattctgggagacacagcgtgggattttggctccatcgggggagtcttcacctctgtgggcaaactcgtgcatcaggtctttgggacggcctacggagtgctgttcagcggcgtttcctggaccatgaagatcgggattggcatccttctgacatggctcggactgaatagccggtctacctccctgagcatgacatgtattgctgtgggcatggtcaccctttacctcggggtgatggttcaagccgactctggatgcgtgatcaactggaaaggcagagaactgaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagactcgaaaatatcatgtggaaacagatcagcaacgagctgaatcatattcttctggaaaacgacatgaagtttaccgtggtcgtgggagacgccaatggcatcctcgctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacaatcagcgggcttggaacatctgggaggtggaggattatggatttggcattttcacgacaaatatctggctgaagctgagagacagctacacccaaatgtgcgatcaccgccttatgtccgcggccattaaagacagcaaggctgtccatgccgatatgggctattggatcgaatctgagaaaaacgaaacatggaagctcgcccgggcttccttcatcgaggttaagacctgtacatggcccaaaagccacaccctgtggtctaatggggtgctggaatccgagatgattatcccgaagatttacggaggccctatcagccagcataactatagacccgggtactttacgcagaccgccggaccttggcacctcggcaaactggagcttgacttcgatctgtgcgaagggacaaccgtggtcgtggacgagcactgcggaaatcgcggcccctctctccggacaaccacggttacaggcaagattatccatgaatggtgttgcagaagctgtaccctgcctcccctgcggtttcgcggggaggatggatgctggtacggcatggagatcagaccggtgaaagaaaaggaggaaaaccttgtccggtccatggtgagcgcggggtctggagaggttgactccttcagcctcggcattctgtgtgtgtccatcatgattgaagaggtcatgagatctcgctggagccggaagatgctgatgacagggaccctcgctgtgtttctgcttctggttatgggacaactcacctggaatgacctgatcagactgtgcattatggtgggcgccaacgcctccgatcgcatgggcatggggacaacgtatcttgctctgatggccaccttcaaaatgagacctatgtttgcggtcggactcctgttccggcgcctcacatctagagaggtgctgcttctgaccatcggcctcagcctggtggcttccgtcgaactgcccaactctcttgaggaactgggggacggactcgccatgggcattatgatgctgaagctcctgacagagtttcagccccaccagctttggaccacgctgctcagcctgacattcatcaaaaccaccctgtcccttgattacgcctggaagacaaccgctatggccctgagcatcgtttctctctttcctctgtgtctctccacaacgagccagaaaaccacatggctgccggtgcttctggggtctttcggatgcaagcccctgaccatgtttctcattacagaaaataagatctggggccggaaatcctggcctctgaacgagggcattatggctatcgggattgtgagcatccttctgtcttccctcctgaagaatgacgtccccctcgccggacctctgatcgcgggcgggatgcttattgcctgttatgtgatcagcggatccagcgctgatctgtctctggagaaagccgctgaagttagctgggagcaagaagccgagcattccggcacctctcacaacattctcgtggaagtccaggacgatgggacgatgaagatcaaagacgaggagcgcgatgacaccctgacaattcttctgaaggccaccctcctggctgtgagcggagtttaccccatgtccatccctgcgacactcttcgtgtggtatttctggcagaaaaagaagcagagatctggcgtcctgtgggatacccccagcccgcctgaagtggagcgggccgtccttgacgatggcatctaccgcattctgcaaagagggctgctcggacggtcccaggtgggcgttggggtgtttcaggacggagtcttccatacaatgtggcacgtgacgcgcggcgctgttctgatgtatcaggggaaaagacttgaaccctcttgggccagcgtgaagaaagacctgatctcctacggaggcggctggcggtttcaagggagctggaataccggagaggaggtccaggtgattgccgtggaacctggcaagaaccccaaaaatgttcagacaaccccggggaccttcaagacacctgagggagaagtcggcgctatcgccctcgattttaagcccgggacgtctggatcccctattgtgaacagagagggcaaaatcgtgggcctgtacgggaatggagtcgtgaccacaagcggcacctatgtttctgcgattgctcaagccaaggcctcccaggaagggcccctccccgagatcgaggacgaagtgttcaaaaagcgcaacctgacaatcatggatcttcaccctggaagcggcaaaacccggagatacctgccggctattgtccgcgaggccatcaagcggaagctgagaacgctcattctggcgcccacacgcgtggttgcttccgaaatggccgaggcccttaaagggatgcctatccggtatcagaccaccgctgtgaagtctgaacatacaggcagagagattgtcgacctgatgtgccacgccacctttacaatgcgcctcctgagccccgtgcgggttcctaattacaacatgatcatcatggatgaggctcatttcaccgaccccgcctccattgcggccagaggatatatcagcacgcgggtgggcatgggggaagctgccgctatttttatgacagccacccctccgggatctgtcgaggccttcccccagtccaatgctgtgatccaagatgaagagcgcgacattcctgaaagaagctggaactctggctacgattggatcacagactttcccgggaaaaccgtgtggttcgtccctagcatcaagtccggaaatgatattgcgaactgtctgcggaaaaacggcaagcgcgttatccagctctctagaaagacgttcgacaccgagtatcagaaaacaaagaataacgactgggattacgtggtgaccacagacattagcgagatgggggccaattttcgggctgatagagtcatcgacccccgccggtgccttaaaccggtgattctgaaggatggccctgaaagagttatcctggccggacccatgcccgtgaccgtcgcctccgctgcccagcgccggggcagaattgggcgcaaccaaaataaagagggagaccagtacgtgtatatgggccagcctctcaacaatgatgaagaccacgcgcattggacagaggctaagatgctgcttgataacatcaatacccccgaggggatcattcctgccctgttcgaaccggagcgggaaaagtctgccgctatcgacggagagtacagactccgcggcgaagccagaaaaacgtttgttgagctgatgcggcgcggggatctgcccgtgtggctcagctataaggtcgcgtccgagggcttccagtacagcgacagacggtggtgctttgatggagaacgcaacaatcaagtgcttgaggaaaacatggacgtcgagatttggacaaaagaaggcgagagaaagaaactgcggcctagatggctggacgcccgcacctattctgatcccctcgctctgcgggagttcaaggaatttgccgctgggagacgctccgtgagcggagaccttatcctggagattggcaaactccctcagcacctgaccctgcgggcccagaatgctctcgataaccttgttatgctgcacaattccgaacaggggggaaaggcctacagacatgcgatggaggaactgcccgacacaatcgagaccctcatgctgcttgccctgatcgctgtgctcacaggcggcgtgacgctgttctttctgtctgggaagggactcggcaaaaccagcattgggcttctgtgtgtcacagcctcctctgctctgctctggatggccagcgttgagccgcactggatcgccgcttccattatcctggaattctttcttatggtgctgctcattcctgagcccgatcggcaacgcacccctcaggacaaccagctggcgtatgtggtcatcggactgctcttcatgatccttacagtggccgctaacgaaatgggcctgctggagaccacgaagaaagatctcgggattggacatgttgccgccgagaatcaccaacacgctaccatgctggacgtggatcttagacccgccagcgcgtggacactgtacgccgtcgctaccacagtgatcacccctatgatgcggcatacgattgaaaacacaaccgccaatatctctctcacagctattgccaaccaggcggccatcctgatgggcctggacaagggctggcccatttccaaaatggatatcggggtcccgctccttgctctgggatgctacagccaggtgaatcctctgaccctcaccgccgctgttctgatgcttgtggcccactatgctatcattggccccgggctgcaggccaaggcgacacgcgaggcccaaaagagaacggctgccggaatcatgaaaaaccccaccgtcgacggcattgtggctatcgatctcgaccctgttgtgtacgacgccaagtttgaaaaacagctggggcagattatgctgctcatcctttgtacatctcagatcctgctgatgcggaccacatgggccctctgcgagtccattaccctggcgacgggaccgcttacaaccctgtgggaaggcagccccggcaagttctggaataccacaatcgctgtctctatggccaacattttccgcgggagctatctcgctggagccggcctggccttttccctgatgaaatctctcgggggaggcagacgggggaccggagctcaaggcgagacacttggcgagaagtggaagcgccagctgaatcagctgagcaaatccgaattcaacacgtacaagagaagcgggatcatggaggtggatcggtccgaagccaaagagggactcaagagaggcgaaaccacaaaacatgcggtgtctcgcgggaccgccaagctgcggtggtttgttgagagaaatcttgtcaagcctgagggaaaagtgattgacctgggctgtgggcgcggaggctggagctattactgcgctggcctcaagaaagtgacagaagtcaaggggtataccaaaggaggccccgggcacgaggaacctatccccatggccacgtacggatggaacctggttaagctgcattccggcaaagatgtgttctttatgcctccggagaagtgtgacaccctcctttgcgatatcggggaatctagccccaatcctacaattgaggagggacggaccctgagagtgctgaagatggtcgaaccctggctccgcggcaaccagttctgtatcaaaattctgaatccttacatgccctccgtggttgaggctcttgaacaaatgcagcggaagcacggcgggatgctggtgagaaacccgctctctcgcaatagcacacacgagatgtattgggtctcctgcggaaccggcaacatcgtgagcgccgttaacatgacatctcggatgctgctgaatagatttaccatggcgcatcgcaaacctacgtacgagcgggacgtggatctcggggccggaacaagacacgtcgctgtggaacccgaggtggccaacctggacattatcggccagcgcattgaaaatatcaagaacgagcataaatccacctggcactatgatgaagacaatccctacaagacctgggcttatcacgggagctacgaggtcaagccttctggatccgccagctctatggttaacggcgtggtgagacttctgacaaaaccctgggatgtcatccctatggtgacgcaaattgctatgaccgacacaaccccgttcggccagcagcgggtttttaaggagaaagtggacacacgcacccccagagccaagcgggggacaacccagatcatggaagtcacggcgaaatggctctggggattcctgtccagaaataagaagcctcggatttgtacccgcgaggaatttacaagaaaagtgcggagcaacgccgctatcggcgccgttttcgtggatgagaatcaatggaactccgctaaggaagccgtcgaggacgagcgcttttgggatcttgtgcatagagaacgggagctgcacaaacaggggaagtgcgccacctgcgtttataatatgatgggaaaacgcgaaaagaagctcggcgagttcgggaaagcgaagggcagcagagctatttggtacatgtggctgggagcccggttcctggaatttgaggccctcggcttcatgaacgaggaccattggttttctcgcgaaaatagcctgtccggggtggagggagaaggccttcacaaactggggtacatcctcagagatatctctaagattcccggaggcaacatgtatgctgacgatacagccgggtgggacacccggatcacggaggatgacctgcagaatgaggctaaaattacagaaatcatggagcctgaacatgcccttctggcgaccagcattttcaagctcacataccagaacaaagtcgtgcgcgtccaaagacccgccaagaacggcaccgtgatggatgttatctcccggcgcgaccagagaggatctggccaggtggggacgtatggactgaatacctttacaaacatggaggtccagctgatccggcaaatggaaagcgagggcattttcctcccgtccgagctggaaacccctaatcttgctgagagagtgctggattggctcgaaaagcacggggccgagcgcctgaaacggatggctatctctggagacgactgtgtggttaagcccattgatgacagatttgccacagcgcttaccgccctgaacgatatgggcaaagtgcgcaaggacatccctcagtgggaacccagcaaagggtggaatgattggcagcaggtccctttctgctcccaccattttcaccaactcattatgaaggacggccgggagatcgtggttccctgtagaaaccaggatgagctggtgggacgcgctcgggtcagccagggcgccgggtggtctctgagagaaacagcttgcctcggaaagtcctacgcccaaatgtggcagctgatgtatttccatcgccgggaccttagactggctgccaatgcgatctgtagcgccgtgccggtcgattgggtgcctacctctcgcacgacatggtccattcacgctcaccatcagtggatgaccaccgaggacatgctcagcgtttggaaccgggtgtggatcgaagagaatccctggatggaagataaaacacaggtctcctcttgggaggaggtgccctacctgggcaagagagaagaccaatggtgcgggagccttattggactgaccgcccgggccacatgggctacgaacatccaggttgccattaatcaggtgagacgcctcatcggcaacgagaattatctggactacatgacctccatgaaacggtttaagaacgaaagcgatcctgagggggcgctgtggtga

SEQ ID NO: 18598 - RNA, 9879 nt, synthetic construct
  misc_feature 1..9879: note = derived and/or modified CDS sequence (opt5) from DENV-1__KF955442__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgacgggacaaccgtggtcgtggatgaacactgcggaaatcgcggcccctctctgcggacaaccacggttacaggcaagattatccatgagtggtgttgcagaagctgtaccctgcctccccttcggttccgcggggaagacggatgctggtacggcatggagatcagaccggtgaaagagaaggaagagaacctcgtccggtccatggtgagcgcggggtctggagaagttgactcctttagcctgggcattctgtgtgcttccatcatgattgaggaagtgatgagatctcgctggagccggaagatgctcatgacagggaccctggccgtcttccttctgctcatcatgggacaactgacctggaatgatctgattagactttgcatcatggtgggcgccaacgcttccgaccgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggagcttcccaactctctggaagagctcggggatggactggccatgggcatcatgatgctcaagctgcttacagaattccagccccaccagctgtggaccacgctcctgagcctgacatttatcaaaaccaccctttccctggactacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagagaataagatttggggccggaaatcctggcctcttaacgaaggcatcatggccattgggatcgttagcatcctgctctcttccctgctcaagaatgatgtgcccctggcgggacctcttattgccggcgggatgctgatcgcttgttatgtgattagcggatccagcgccgacctgtctctcgagaaagctgccgaggtcagctgggaacaagaggccgaacattccggcacctctcacaacatcctggtggaggttcaggatgacgggacgatgaagattaaagatgaagagcgcgacgatacccttacaatcctgctcaaggctaccctgctcgcggtgagcggagtctaccccatgtccatccctgccacactgtttgtgtggtatttctggcagaaaaagaagcagagatctggcgttctttgggacacccccagcccgcctgaggtggaacgggctgtcctggatgacggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggagccctcttgggccagcgtgaagaaagatctcatttcctacggaggcggctggcggttccaagggagctggaataccggagaagaggttcaggtgatcgctgtcgagcctggcaagaaccccaaaaatgtgcagacaaccccggggacctttaagacacctgaaggagaggtgggcgccattgcgctggacttcaagcccgggacgtctggatcccctatcgttaacagagaaggcaaaattgtcggcctctacgggaatggagtggtgaccacaagcggcacctatgtctctgctatcgcccaagccaaggcttcccaggaggggcccctgcccgaaatcgaggatgaggtgtttaaaaagcgcaaccttacaattatggacctgcaccctggaagcggcaaaacccggagatacctgccggccatcgttcgcgaagcgattaagcggaagctcagaacgctgatccttgctcccacacgcgtggtcgcctccgagatggccgaagctctgaaagggatgcctattcggtatcagaccaccgccgtgaagtctgagcatacaggcagagaaatcgttgatctcatgtgccacgctaccttcacaatgcgcctgctgagccccgtgcgggtccctaattacaacatgatcattatggacgaggcccattttaccgatcccgcgtccatcgccgctagaggatatattagcacgcgggtgggcatgggggaggccgctgccatcttcatgacagccacccctccgggatctgttgaagcttttccccagtccaatgcggtgattcaagacgaggaacgcgatatccctgagagaagctggaactctggctacgactggatcacagatttccccgggaaaaccgtctggtttgtgcctagcattaagtccggaaatgacatcgccaactgtctccggaaaaacggcaagcgcgtgattcagctttctagaaagacgttcgacaccgaatatcagaaaacaaagaataacgattgggactacgtcgttaccacagatatcagcgagatgggggctaatttccgggccgacagagtgattgatccccgccggtgcctgaaaccggtgatcctgaaggacggccctgagagagtcattctcgccggacccatgcccgtgaccgttgcttccgccgcgcagcgccggggcagaatcgggcgcaaccaaaataaagaaggagatcagtacgtgtatatgggccagcctctgaacaatgacgaggatcacgctcattggacagaagccaagatgcttctggacaacatcaatacccccgaggggattatccctgccctctttgagccggaacgggagaagtctgctgccattgatggagaatacagactgcgcggcgaggcgagaaaaacgttcgtcgaactgatgcggcgcggggacctccccgtgtggcttagctataaggttgcctccgagggctttcagtacagcgatagacggtggtgcttcgacggagagcgcaacaatcaagtgctggaagagaacatggacgtcgaaatctggacaaaagagggcgaaagaaagaaactgcggcctagatggctcgatgctcgcacctattctgaccccctggcccttcgggagtttaaggagttcgctgccgggagacgctccgtgagcggagatctgattctcgaaatcggcaaactgcctcagcacctgaccctccgggctcagaatgcccttgacaacctggtcatgctgcacaattccgagcaggggggaaaggcgtacagacatgccatggaagagctccccgatacaatcgaaaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgagtttttcctgatggtcctcctgatccctgaacccgaccggcaacgcacccctcaggataaccagctggcctatgttgtgatcggactcctttttatgattctgacagtggctgccaacgagatgggcctgctcgaaaccacgaagaaagacctggggatcggacatgtcgccgctgagaatcaccaacacgccaccatgcttgatgtggacctgagacccgcgagcgcctggacactctacgctgttgccaccacagtgattacccctatgatgcggcatacgatcgagaacacaaccgctaatatttctctgacagccatcgcgaaccaggccgctattctgatgggcctcgataagggctggcccatctccaaaatggacatcggggtcccgcttctggccctgggatgctacagccaggtgaatcctctcaccctgaccgctgccgtccttatgctggtggctcactatgccattatcggccccgggctccaggcgaaggccacacgcgaagctcaaaagagaacggccgctggaattatgaaaaaccccaccgttgatggcatcgtggccattgacctggaccctgtcgtgtacgatgccaagttcgagaaacagctggggcagatcatgctccttatcctgtgtacatctcagattctgctcatgcggaccacatgggcgctgtgcgaatccatcacccttgctacgggaccgctgacaaccctctgggagggcagccccggcaagttttggaataccacaattgccgtttctatggctaacatcttccgcgggagctatctggccggagccggcctggctttctccctcatgaaatctcttgggggaggcagacgggggaccggagcccaaggcgaaacactgggcgagaagtggaagcgccagctgaatcagctcagcaaatccgagtttaacacgtacaagagaagcgggattatggaagtggaccggtccgaggcgaaagaaggactgaagagaggcgagaccacaaaacatgccgtctctcgcgggaccgctaagcttcggtggttcgtggaaagaaatctggtgaagcctgagggaaaagttatcgatctcggctgtgggcgcggaggctggagctattactgcgccggcctgaagaaagtcacagaggtgaaggggtataccaaaggaggccccgggcacgaagagcctatccccatggctacgtacggatggaacctggtgaagctccattccggcaaagacgtctttttcatgcctccggaaaagtgtgatacccttctgtgcgacattggggagtctagccccaatcctacaatcgaagagggacggaccctgagagttctcaagatggtggagccctggctgcgcggcaaccagttttgtattaaaatccttaatccttacatgccctccgtggtcgaaacactggagcaaatgcagcggaagcacggcgggatgctcgtgagaaacccgctgtctcgcaatagcacccacgaaatgtattgggtttcctgcggaacaggcaacattgtgagcgccgtcaacatgacctctcggatgctgctcaatagattcacgatggcgcatcgcaaacctacatttgagcgggatgtggacctgggggccggaaccagacacgttgctgtggagcccgaagtcgccaaccttgatatcattggccagcgcatcgagaatatcaagaacgaacataaatccacctggcactacgacgaggataatccctataagacatgggcttaccacgggagctatgaagtgaagccttctggatccgccagctctatggtgaacggcgtcgttagactgctcacgaaaccctgggacgtgattcctatggtgacccaaatcgctatgacagacaccacaccgttcggccagcagcgggtctttaaggagaaagtggatacccgcacacccagagccaagcgggggaccacgcagattatggaggttaccgcgaaatggctgtggggattcctttccagaaataagaagcctcggatctgtacacgcgaagagtttaccagaaaagtgcggagcaacgccgctattggcgccgtcttcgtggacgaaaatcaatggaactccgctaaggaggccgttgaagatgagcgcttttgggacctggtgcatagagagcgggaactccacaaacaggggaagtgcgccacatgcgtctacaatatgatgggaaaacgcgagaagaagctgggcgaattcgggaaagcgaagggcagcagagctatctggtatatgtggctgggagcccggttcctcgagtttgaagccctgggcttcatgaacgaggatcattggttttctcgcgagaatagcctttccggggtggaaggagagggcctgcacaaactcgggtacatcctgagagacatttctaagatccccggaggcaacatgtacgctgatgacaccgccgggtgggatacgcggattacagaagacgatcttcagaatgaggctaaaatcaccgacattatggagcctgaacatgccctgctcgcgacaagcatcttcaagctgacctatcagaacaaagttgtgcgcgtccaaagacccgccaagaacggcacggtgatggatgtcatctcccggcgcgaccagagaggatctggccaggtggggacctacggactgaatacatttaccaacatggaggttcagctcattcggcaaatggaaagcgagggcatcttcctgccgtccgaacttgagacacctaatctggctgagagagtgctcgactggctggaaaagcacggggccgagcgccttaaacggatggctatttctggagatgactgtgtcgtgaagcccatcgatgacagatttgccaccgcgctgacagccctcaacgatatgggcaaagtgcgcaaggacattcctcagtgggaacccagcaaagggtggaatgattggcagcaggttcctttctgctcccaccattttcaccaactgatcatgaaggacggccgggagatcgtggtcccctgtagaaaccaggatgaactggtgggacgcgctcgggttagccagggcgccgggtggtctctcagagagaccgcttgcctgggaaagtcctatgcccaaatgtggcagcttatgtacttccatcgccgggacctgagactcgctgccaatgcgatttgtagcgccgtgccggtcgattgggtgcctacgtctcgcacaacctggtccatccacgctcaccatcagtggatgaccacagaggacatgctgagcgtctggaaccgggtgtggattgaagagaatccctggatggaagacaaaacccacgtttcctcttgggaggaagtgccctatcttggcaagagagaggatcagtggtgcgggagcctgatcggactcacagcccgggccacgtgggctaccaacattcaagtcgccatcaatcaggtgagacgcctgattggcaacgagaattacctggactatatgacatccatgaaacggtttaagaacgaaagcgatcctgagggggcgctctggtga

SEQ ID NO: 18599 - RNA, 9879 nt, synthetic construct
  misc_feature 1..9879: note = derived and/or modified CDS sequence (opt5) from DENV-1__GU131965__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggtgcttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaagaataaacccacactggatatcgaactcctgaagaccgaggttacaaaccctgctattcttcggaaactgtgcatcgaagccaagatttctaataccacgacagactcccgctgtccgacccagggagaggcgaccctcgtggaagaacaggatgccaacttcgtgtgcagacggacatttgtcgaccgcggctggggcaatgggtgtggactgttcggcaaagggagccttctgacctgcgctaagtttaagtgcgtgacaaaactcgagggaaagatcgttcagtacgaaaacctgaaatattctgtgatcgtcacggtgcacaccggcgatcaacatcaggttgggaatgagacaaccgaacacggaacaattgccaccatcacgccccaggctcctacctccgagattcagctgacagactacggcgccctcaccctggactgtagccccagaacaggccttgatttcaacgaaatggtgctgctcaccatgaaggagaaatcttggctggtccataagcaatggtttcttgacctgcctctcccctggacgtccggggccagcacatcccaggagacctggaatcggcaggatctgctggtgacattcaaaaccgctcacgcgaagaagcaagaagtcgtggttctcggatctcaggagggcgccatgcacaccgctctgacaggggccacggaaatccagaccagcggaacaaccacaatttttgccggccatcttaaatgccgcctgaagatggacaaactcaccctgaaggggacgtcctatgtgatgtgtacaggcagcttcaaactggagaaggaagtcgctgagacccagcacggaaccgtgcttgttcaagtgaagtacgagggcacagatgccccgtgcaaaatccctttctctacccaggacgaaaagggggtcacacagaacggaagactcatcacggcgaatcccattgtgaccgataaagagaagcctgtgaacatcgaaacagagccgccctttggcgagtcctatattgttgtcggggctggagaaaaagccctgaagctgagctggttcaagaaaggctctagcatcgggaagatgtttgaggccaccgctcggggcgccagacgcatggctattctcggagacacagcctgggatttcggctccatcgggggagtgtttacctctgtgggcaaactggtccatcaggtgttcgggacggcgtacggagttctttttagcggcgtgtcctggaccatgaagatcgggattggcatcctgctcacatggctgggactgaatagccggaacacctctctttccatgacatgtattgccgtcggcatggtgaccctctacctgggggttatggtgcaagctgacagcggatgcgtcatcaactggaaaggcagagaactgaagtgtgggtctggaattttcgtgacaaatgaggttcacacctggacggaacagtataagtttcaggccgattcccctaaacgcctcagcgctgccatcggcaaggcgtgggaggagggggtgtgcggcattcggtccgccacaagactggaaaacatcatgtggaaacagatctctaatgagcttaaccatattctgctcgaaaatgacatgaagttcaccgtcgtggtgggagacgctaacggcatcctggcccaagggaaaaagatgattcgcccgcagcccatggagcacaaatacagctggaagtcctggggaaaggctaaaatcattggcgccgatatccagaataccacatttatcattgacgggcctgatacccccgaatgtcctgacaaccagcgggcctggaatatctgggaggtcgaggattatggattcggcatttttacgacaaacatctggctgaaacttagagactcttacacccaaatgtgcgatcaccgcctcatgagcgctgcgattaaagactccaaggccgttcatgctgatatgggctattggatcgaaagcgagaaaaatgaaacatggaagctggcccgggcctctttcatcgaggtgaagacctgtacatggcccaaatcccacaccctgtggagcaacggggtgctcgaatctgagatgattatcccgaagatttacggaggccctatctcccagcataattatagacccgggtacttcacgcagaccgctggaccttggcacctgggcaaacttgagctggactttgatctctgcgaagggacaaccgtcgtggttgacgagcactgcggaaaccgcggccccagcctgcggacaaccacggccacaggcaagattatccatgaatggtgttgcagatcttgtaccctgcctccccttcggttccgcggggaggatggatgctggtacggcatggagatcagaccggtgaaagaaaaggaggaaaatctcgtccggagcatggtgtccgcggggagcggagaggttgactctttttccctgggcattctgtgtgctagcatcatgattgaagaggtgatgagatcccgctggtctcggaagatgctcatgacagggaccctggccgtcttccttctgctcgtgatgggacaactgacctggaacgacctgatcagactttgcattatggttggcgccaacgctagcgatcgcatgggcatggggacaacgtatctggccctcatggcgacctttaaaatgagacctatgttcgctgtgggactgctctttcggcgcctgacatccagagaggtccttctgctcaccatcggcctgtctctggtggccagcgtggaacttcccaattccctggaggaactcggggacggactggccatgggcattatgatgctcaagctgcttacagagttccagccccaccagctgtggaccacgctcctgtctctgacatttatcaaaaccacccttagcctggattacgcttggaagacaaccgccatggctctctccatcgtcagcctgttccctctctgtctgtctacaacgtcccagaaaaccacatggcttccggttctgctggggagctttggatgcaagcccctcaccatgttcctgattacagaaaacaagatctggggccggaaatcttggcctcttaatgagggcattatggccatcgggattgtgtccatcctgctcagctctctgctcaagaacgacgtgcccctggcgggacctcttatcgccggcgggatgctgattgcttgttatgtcatctccggaagctccgccgatctgagcctcgagaaagctgccgaagtgtcttgggagcaagaagccgagcatagcggcacctcccacaatattctggttgaagtgcaggacgatgggacgatgaagatcaaagacgaggagcgcgatgacacccttacaattctgctcaaggctaccctgctcgcggtctctggagtgtaccccatgagcatccctgccacactgtttgtttggtatttctggcagaaaaagaagcagagatccggcgtgctttgggataccccctctccgcctgaagtcgagcgggctgtgctggacgatggcatctaccgcattctgcaaagagggctcctgggacggagccaggtcggcgtgggggttttccaggacggagtgtttcatacaatgtggcacgtcacgcgcggcgccgtgcttatgtatcaggggaaaagactggaaccctcctgggcctctgttaagaaagacctcatcagctacggaggcggctggcggttccaagggtcctggaacaccggagaggaggtgcaggtcattgctgtggaacctggcaagaatcccaaaaacgtgcagacaaccccggggacctttaagacacctgagggagaagttggcgccatcgcgctggatttcaagcccgggacgagcggatctcctattgtcaatagagagggcaaaatcgtgggcctctacgggaacggagtggtcaccacatccggcacctatgtgagcgctattgcccaagccaaggcttctcaggaagggcccctgcccgagatcgaggacgaagtttttaaaaagcgcaatcttacaatcatggatctgcaccctggatccggcaaaacccggagatacctgccggccattgtgcgcgaggcgatcaagcggaagctcagaacgctgattcttgctcccacacgcgtcgtggccagcgaaatggccgaggctctgaaagggatgcctatccggtatcagaccaccgccgttaagtccgaacatacaggcagagagattgtggacctcatgtgccacgctaccttcacaatgcgcctgctgtctcccgtccgggtgcctaactacaatatgatcatcatggatgaggcccattttaccgaccccgcgagcattgccgctagaggatatatctccacgcgggttggcatgggggaagccgctgccattttcatgacagccacccctccgggaagcgtggaggcttttccccagtctaacgcggtcatccaagatgaagaacgcgacattcctgaaagatcctggaatagcggctacgattggatcacagacttccccgggaaaaccgtgtggtttgtgccttctatcaagagcggaaacgatattgccaactgtctccggaaaaatggcaagcgcgtcatccagctttccagaaagacgttcgacaccgagtatcagaaaacaaagaacaatgactgggattacgttgtgaccacagacatttctgagatgggggctaacttccgggccgatagagtgatcgacccccgccggtgcctgaaaccggtcattctgaaggatggccctgaaagagtgatcctcgccggacccatgcccgttaccgtggctagcgccgcgcagcgccggggcagaattgggcgcaatcaaaacaaagagggagaccagtacgtctatatgggccagcctctgaataacgatgaagaccacgctcattggacagaggccaagatgcttctggataatatcaacacccccgaggggatcattcctgccctctttgaaccggagcgggaaaagtccgctgccatcgacggagagtacagactgcgcggcgaagcgagaaaaacgttcgtggagctgatgcggcgcggggatctccccgtttggctttcttataaggtggccagcgagggctttcagtactccgacagacggtggtgcttcgatggagaacgcaataaccaagtcctggaggaaaatatggacgtggagatttggacaaaagaaggcgagagaaagaaactgcggcctagatggctcgacgctcgcacctatagcgatcccctggcccttcgggagtttaaggagttcgctgccgggagacgctctgtctccggagacctgatcctcgagattggcaaactgcctcagcacctgaccctccgggctcagaacgcccttgataatctggtgatgctgcacaacagcgaacaagggggaaaggcgtacagacatgccatggaggaactccccgacacaatcgagaccctgatgcttctggctctcatcgccgttctgacaggcggcgtgacgctgtttttcctctccgggaagggacttggcaaaacctctattgggctgctgtgtgtgacagctagctccgccctcctgtggatggcctctgtcgagccgcactggatcgctgcgagcattatccttgaatttttcctgatggttctcctgattcctgagcccgatcggcaacgcacccctcaggacaaccagctggcctatgtggtgatcggactcctttttatgatcctgacagtcgctgccaatgaaatgggcctgctcgagaccacgaagaaagatctggggattggacatgtggccgctgagaaccaccaacacgccaccatgcttgacgttgatctgagacccgcgtccgcctggacactctacgctgtggccaccacagtcatcacccctatgatgcggcatacgattgaaaatacaaccgctaacatcagcctgacagccattgcgaatcaggccgctatcctgatgggcctcgacaagggctggcccatttctaaaatggatatcggggtgccgcttctggccctgggatgctactcccaggtcaaccctctcaccctgaccgctgccgtgcttatgctggttgctcactatgccatcattggccccgggctccaggcgaaggccacacgcgaggctcaaaagagaacggccgctggaatcatgaaaaatcccaccgtggacggcattgtcgccatcgatctggaccctgtggtttacgacgccaagttcgaaaaacagctggggcagattatgctccttatcctgtgtacaagccagatcctgctcatgcggaccacatgggcgctgtgcgagtctattacccttgctacgggaccgctgacaaccctctgggaaggctcccccggcaagttttggaacaccacaatcgccgtgagcatggctaatattttccgcgggtcttatctggccggagccggcctggctttcagcctcatgaaatcccttgggggaggcagacgggggaccggagcccaaggcgagacactgggcgagaagtggaagcgccagctgaaccagctctctaaaagcgaatttaatacgtacaagagatccgggatcatggaggtcgatcggagcgaagcgaaagagggactgaagagaggcgaaaccacaaaacatgccgtgtcccgcgggaccgctaaacttcggtggttcgtggagagaaacctggttaagcctgagggaaaagtcattgacctcggctgtgggcgcggaggctggtcttattactgcgccggcctgaagaaagtgacagaagtgaaggggtataccaaaggaggccccgggcacgaggaacctatccccatggctacgtacggatggaatctggtcaagctccatagcggcaaagatgtgtttttcatgcctccggagaagtgtgacacccttctgtgcgatatcggggaatcctctcccaaccctacaattgaggagggacggaccctgagagttctcaagatggtggaaccctggctgcgcggcaatcagttttgtatcaaaattcttaacccttacatgcccagcgtcgtggagacactggaacaaatgcagcggaagcacggcgggatgctcgttagaaatccgctgtcccgcaactctacccacgagatgtattgggtgagctgcggaacaggcaacatcgtctccgccgtgaatatgaccagccggatgctgctcaacagattcacgatggcgcatcgcaaacctacatacgagcgggacgttgatctgggggccggaaccagacacgtggctgtcgaacccgaggtggccaatcttgacattatcggccagcgcattgaaaacatcaagaatgagcataaatctacctggcactatgatgaagacaacccctacaagacatgggcttatcacgggtcctacgaggtgaagcctagcggatctgcctccagcatggtcaatggcgttgtgagactgctcacgaaaccctgggatgtgatccctatggtcacccaaattgctatgacagacaccacaccgtttggccagcagcgggtgttcaaggagaaagttgacacccgcacacccagagccaagcgggggaccacgcagatcatggaagtgaccgcgaaatggctgtggggatttctttctagaaacaagaagcctcggatttgtacacgcgaggagttcaccagaaaagtccggtccaatgccgctatcggcgccgtgtttgttgatgagaaccaatggaatagcgctaaggaagccgtggaggacgagcgcttctgggatctggtccatagagaacgggagctccacaaacaggggaagtgcgccacatgcgtgtataacatgatgggaaaacgcgaaaagaagctgggcgagtttgggaaagcgaagggctccagagctatttggtacatgtggctgggagcccggttcctcgagttcgaggccctgggctttatgaatgaggaccattggttcagccgcgaaaactctcttagcggggttgagggagaaggcctgcacaaactcgggtacatcctgagagatatctccaagattcccggaggcaatatgtatgctgacgataccgccgggtgggacacgcggatcacagaggatgaccttcagaacgaggctaaaattaccgaaatcatggagcctgaacatgccctgctcgcgacatctatttttaagctgacctaccagaacaaagtggtccgcgtgcaaagacccgccaagaatggcacggtcatggatgtgatcagccggcgcgaccagagaggatccggccaggttgggacctatggactgaacacattcaccaatatggaggtgcagctcatccggcaaatggaatctgagggcatttttctgccgagcgagcttgaaacacctaacctggctgagagagtcctcgattggctggaaaagcacggggccgagcgccttaaacggatggctatctccggagacgactgtgtggtgaagcccattgatgacagattcgccaccgcgctgacagccctcaatgatatgggcaaagttcgcaaggacatccctcagtgggaaccctctaaagggtggaacgattggcaacaggtgcctttttgcagccaccatttccaccaactgattatgaaggacggccgggagatcgtcgtgccctgtagaaatcaggatgagctggttggacgcgctcgggtgtcccagggcgccgggtggagcctcagagaaaccgcttgcctgggaaagtcttacgcccaaatgtggcagcttatgtattttcatcgccgggacctgagactcgctgccaacgcgatctgttccgccgtcccggtggattgggtccctacgagccgcacaacctggtctattcacgctcaccatcagtggatgaccacagaggacatgctgtccgtgtggaatcgggtttggatcgaagagaacccctggatggaagataaaacccacgtgagctcctgggaggaggtcccctaccttggcaagagagaagaccagtggtgcgggtctctgattggactcacagcccgggccacgtgggctaccaatatccaagtggccattaaccaggttagacgcctgatcggcaatgagaactatctggactacatgacaagcatgaaacggttcaagaatgaatccgatcctgagggggcgctctggtga

SEQ ID NO: 18600 - RNA, 9879 nt, synthetic construct
  misc_feature 1..9879: note = derived and/or modified CDS sequence (opt5) from DENV-1__GU131966__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacagacggagcgggattatggaggtggatagatccgaagcgaaggagggactgaaacgcggcgaaaccacaaagcatgccgtctctcgggggaccgctaaacttagatggttcgtggagcgcaatctggtgaagcctgagggaaaggttatcgacctcggctgtgggcggggaggctggagctattactgcgccggcctgaaaaaggtcacagaagtgaaagggtataccaagggaggccccgggcacgaggaacctatccccatggctacgtacggatggaacctggtgaaactccattccggcaaggatgtctttttcatgcctccggagaaatgtgacacccttctgtgcgatattggggaatctagccccaatcctacaatcgaggagggaagaaccctgcgcgttctcaagatggtggaaccctggctgcggggcaaccagttttgtattaagatccttaatccttacatgccctccgtggtcgagacactggaacaaatgcagagaaaacacggcgggatgctcgtgcgcaacccgctgtctcggaatagcacccacgagatgtattgggtttcctgcggaacaggcaacattgtgagcgccgtcaacatgacctctagaatgctgctcaatcgcttcacgatggcgcatcggaagcctacatttgagagagacgtggatctgggggccggaacccgccacgttgctgtggaacccgaggtcgccaaccttgacatcattggccagagaatcgaaaatatcaaaaacgagcataagtccacctggcactacgatgaagacaatccctataaaacatgggcttaccacgggagctatgaggtgaagccttctggatccgccagctctatggtgaacggcgtcgttcggctgctcacgaagccctgggatgtgattcctatggtgacccaaatcgctatgacagacaccacaccgttcggccagcagcgcgtctttaaagagaaggtggacaccagaacaccccgggccaaaagagggaccacgcagattatggaagttaccgcgaagtggctgtggggattcctttcccggaataaaaagcctcgcatctgtacaagagaggaatttacccggaaggtgcgcagcaacgccgctattggcgccgtcttcgtggatgagaatcaatggaactccgctaaagaagccgttgaggacgagagattttgggatctggtgcatcgggaacgcgagctccacaagcaggggaaatgcgccacatgcgtctacaatatgatgggaaagagagaaaaaaagctgggcgagttcgggaaggcgaaaggcagccgggctatctggtatatgtggctgggagcccgcttcctcgaatttgaggccctgggcttcatgaacgaggaccattggttttctagagaaaatagcctttccggggtggagggagaaggcctgcacaagctcgggtacatcctgcgggatatttctaaaatccccggaggcaacatgtacgctgacgataccgccgggtgggacacgcgcattacagaggatgaccttcagaatgaggctaagatcaccgatattatggaacctgagcatgccctgctcgcgacaagcatcttcaaactgacctatcagaacaaggttgtgagagtccaacggcccgccaaaaacggcacggtgatggacgtcatctcccgcagagatcagcggggatctggccaggtggggacctacggactgaatacatttaccaacatggaagttcagctcattagacaaatggagagcgaaggcatcttcctgccgtccgagcttgagacacctaatctggctgaacgcgtgctcgactggctggagaagcacggggccgaacggcttaagagaatggctatttctggagacgattgtgtcgtgaaacccatcgacgatcgctttgccaccgcgctgacagccctcaacgacatgggcaaggtgcggaaagatattcctcagtgggagcccagcaaggggtggaatgactggcagcaggttcctttctgctcccaccattttcaccaactgatcatgaaagatggcagagaaatcgtggtcccctgtcgcaaccaggacgagctggtgggacgggctagagttagccagggcgccgggtggtctctccgcgagaccgcttgcctgggaaagtcctatgcccaaatgtggcagcttatgtacttccatcggagagatctgcgcctcgctgccaatgcgatttgtagcgccgtgccggtcgactgggtgcctacgtctcggacaacctggtccatccacgctcaccatcagtggatgaccacagaagatatgctgagcgtctggaacagagtgtggattgaggaaaatccctggatggaggacaagacccacgtttcctcttgggaagaggtgccctatcttggcaaacgggaggaccagtggtgcgggagcctgatcggactcacagccagagccacgtgggctaccaacattcaagtcgccatcaatcaggtgcgccggctgattggcaacgaaaattacctggattatatgacatccatgaagagatttaaaaacgagagcgaccctgaaggggcgctctggtga

SEQ ID NO: 18601 - RNA, 9879 nt, synthetic construct
  misc_feature 1..9879: note = derived and/or modified CDS sequence (opt5) from DENV-1__GQ868501__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaatcaaatttggggccggaagtcctggcctcttaacgagggcatcatggccattgggatcgttagcatcctgctctcttccctgctcaaaaatgacgtgcccctggcgggacctcttattgccggcgggatgctgatcgcttgttatgtgattagcggatccagcgccgatctgtctctcgagaagaccgctgaagtcagctgggagcaggaagccgagcattccggcacgtctcacaacatcctggtggaagttcaggacgatgggaccatgaaaattaaggacgaggagcgcgatgacacacttaccatcctgctcaaagccacactgctcgctgtgagcggagtctaccccatgtccatccctgcgaccctgtttgtgtggtatttctggcagaagaaaaagcaaagatctggcgttctttgggatacacccagcccgcctgaagtggagcgggccgtcctggacgatggcatttaccgcatcctgcagagagggctcctgggacggtcccaggtgggcgtcggggtgttccaggacggagtttttcatacgatgtggcacgtgacccgcggcgctgtccttatgtatcaagggaagagactggaaccctcttgggccagcgtgaaaaaggacctcatttcctacggaggcggctggcggttccaggggagctggaatacaggagaggaggttcaggtgatcgccgtcgaacctggcaaaaaccccaagaatgtgcaaaccaccccggggacatttaaaacgcctgagggagaagtgggcgctattgccctggatttcaagcccgggacctctggatcccctatcgttaacagagagggcaagattgtcggcctctacgggaatggagtggtgacaaccagcggcacatatgtctctgcgatcgctcaggccaaagcctcccaggaagggcccctgcccgagatcgaggacgaagtgtttaagaaacgcaaccttaccattatggatctgcaccctggaagcggcaagacgcggagatacctgccggctatcgttcgcgaggccattaaacggaagctcagaacactgatccttgcgcccacccgcgtggtcgcttccgaaatggccgaggccctgaaggggatgcctattcggtatcagaccacagctgtgaaatctgaacataccggcagagagatcgttgacctcatgtgccacgccacattcaccatgcgcctgctgagccccgtgcgggtccctaattacaacatgatcattatggatgaggctcattttacggaccccgcctccatcgcggccagaggatatattagcacacgggtgggcatgggggaagctgccgctatcttcatgaccgccacacctccgggatctgttgaggcctttccccaatccaatgctgtgattcaggatgaagagcgcgacatccctgaaagaagctggaactctggctacgattggatcaccgacttccccgggaagacggtctggtttgtgcctagcattaaatccggaaatgatatcgcgaactgtctccggaagaacggcaaacgcgtgattcagctttctagaaagaccttcgacacagagtatcagaagaccaaaaataacgactgggattacgtcgttacaaccgacatcagcgagatgggggccaatttccgggctgatagagtgattgacccccgccggtgcctgaagccggtgatcctgaaagatggccctgaaagagtcattctcgccggacccatgcccgtgacagttgcctccgctgcccaacgccggggcagaatcgggcgcaaccagaataaggagggagaccagtacgtgtatatgggccagcctctgaacaatgatgaagaccacgcgcattggaccgaggctaaaatgcttctggataacatcaatacgcccgaggggattatccctgccctctttgaaccggagcgggaaaagtctgccgctattgacggagagtacagactgcgcggcgaagccagaaagacattcgtcgagctgatgcggcgcggggatctccccgtgtggcttagctataaagttgcgtccgagggctttcaatacagcgacagacggtggtgcttcgatggagaacgcaacaatcaggtgctggaggaaaacatggacgtcgagatctggaccaaggaaggcgagagaaaaaagctgcggcctagatggctcgacgcccgcacctattctgatcccctggctcttcgggagtttaaagaattcgccgctgggagacgctccgtgagcggagacctgattctcgagatcggcaagctgcctcagcacctgacactccgggcccagaatgctcttgataacctggtcatgctgcacaattccgaacaagggggaaaagcctacagacatgcgatggaggaactccccgacaccatcgagacactgatgcttctggccctcattgctgtgctgacgggcggcgttaccctgtttttcctctctgggaagggacttggcaagacaagcatcgggctgctgtgtgtgaccgcctcctctgctctcctgtggatggccagcgtggagccgcactggattgccgcttccatcattcttgaatttttcctgatggtcctcctgatccctgagcccgatcggcagcgcacacctcaggacaaccaactggcgtatgttgtgatcggactcctttttatgattctgaccgtggccgctaacgaaatgggcctgctcgagacgaccaaaaaggatctggggatcggacatgtcgccgccgagaatcaccagcacgctacaatgcttgacgtggatctgagacccgccagcgcgtggaccctctacgccgttgctacaaccgtgattacgcctatgatgcggcatacaatcgaaaacaccacagccaatatttctctgaccgctatcgccaaccaggcggccattctgatgggcctcgacaaaggctggcccatctccaagatggatatcggggtcccgcttctggctctgggatgctacagccaggtgaatcctctcaccctgacagccgctgtccttatgctggtggcccactatgctattatcggccccgggctccaagccaaagcgacgcgcgaggcccagaagagaaccgctgccggaattatgaagaaccccacagttgacggcatcgtggctattgatctggaccctgtcgtgtacgacgccaaattcgaaaagcagctggggcagatcatgctccttatcctgtgtacctctcaaattctgctcatgcggacaacctgggccctgtgcgagtccatcacgcttgcgacaggaccgctgaccaccctctgggaaggcagccccggcaaattttggaatacaaccattgctgtttctatggccaacatcttccgcgggagctatctggctggagccggcctggccttctccctcatgaagtctcttgggggaggcagacgggggacaggagctcagggcgagacgctgggcgagaaatggaagcgccagctgaatcagctcagcaagtccgaatttaacacctacaaaagaagcgggattatggaggtggatcggtccgaagccaaggagggactgaaaagaggcgaaacaaccaagcatgcggtctctcgcgggacagccaaacttcggtggttcgtggagagaaatctggtgaagcctgagggaaaggttatcgacctcggctgtgggcgcggaggctggagctattactgcgctggcctgaaaaaggtcaccgaagtgaaagggtatacgaagggaggccccgggcacgaggaacctatcctgatggccacctacggatggaacctcgtggagcttcattccggcaaagatgtctttttcatgccccctgaaaagtgtgacacactgctgtgcgatattggggagtctagcccgaatcccaccatcgaggaaggacggacactcagagttctgaaaatggtggagccttggcttcgcggcaaccaattttgtattaagatcctgaatccctacatgccttccgtggtcgaaaccctcgagcagatgcagcggaagcacggcgggatgctggtgagaaaccccctgtctcgcaatagcacacacgagatgtattgggtttcctgcggaaccggcaacattgtgagcgctgtcaacatgacgtctcggatgctcctgaatagattcacaatggcccatcgcaaaccgacctttgaacgggacgtggatcttggggcgggaaccagacacgttgccgtggagcctgaagtcgctaacctggacatcattggccaacgcatcgagaatatcaagaacgaacataaatccacatggcactacgatgaggacaatccctataagacgtgggcctaccacgggagctatgaggtgaaaccctctggatccgctagctctatggtgaacggcgtcgttagactcctgaccaagccttgggatgtgattcccatggtgacacagatcgccatgaccgacacaacccctttcggccagcagcgggtctttaaggaaaaagtggacacacgcaccccgagagctaagcgggggacgacccaaattatggaggttacagccaaatggctttggggattcctgtccagaaataagaaaccccggatctgtacccgcgaagagtttacaagaaaggtgcggagcaacgcggccattggcgctgtcttcgtggatgaaaatcagtggaactccgccaaggaggctgttgaggacgaacgcttttgggatctcgtgcatagagagcgggaactgcacaaacaggggaagtgcgccacctgcgtctacaatatgatgggaaaacgcgagaagaaactgggcgaattcgggaaggccaagggcagcagagcgatctggtatatgtggctcggagctcggttcctggagtttgaggcccttggcttcatgaacgaagaccattggttttctcgcgagaatagcctgtccggggtggaaggagagggcctccacaaactggggtacatccttagagatatttctaagatccctggaggcaacatgtacgccgacgatacggctgggtgggacacacggattaccgaggatgacctgcagaatgaagccaaaatcacagatattatggagcccgaacatgctctcctggccaccagcatcttcaagctgacgtatcaaaacaaagttgtgcgcgtccagagacctgcgaagaacggcaccgtgatggacgtcatctcccggcgcgatcagagaggatctggccaggtggggacatacggactcaatacctttacaaacatggaggttcaactgattcggcagatggaaagcgagggcatcttccttccctccgagctggaaaccccgaatctcgccgagagagtgctggactggcttgaaaaacacggggctgagcgcctgaagcggatggccatttctggagacgattgtgtcgtgaagcctatcgacgatagatttgctacagccctcaccgcgctgaacgacatgggcaaagtgcgcaaggatattccccagtgggaacctagcaaagggtggaatgactggcagcaagttcccttctgctcccaccattttcaccagctgatcatgaaggatggccgggagatcgtggtcccttgtagaaaccaggacgagctcgtgggacgcgcccgggttagccaaggcgctgggtggtctctgagagaaacggcctgccttggaaaatcctatgctcagatgtggcagctgatgtacttccatcgccgggatctcagactggccgctaatgccatttgtagcgcggtgcccgtcgactgggtgccgacatctcgcaccacctggtccatccacgcccaccatcagtggatgacaaccgaggatatgcttagcgtctggaaccgggtgtggattgaagagaatccttggatggaagacaagacacacgtttcctcttgggaggaggtgccctatctgggcaagagagaagaccaatggtgcgggagcctcatcggactgacggctcgggccacctgggccacaaacattcaggtcgctatcaatcaggtgagacgcctgattggcaacgagaattacctcgattatatgacctccatgaaacggtttaagaacgaaagcgaccccgagggggccctgtggtga

SEQ ID NO: 18602 - RNA, 9879 nt, synthetic construct
  misc_feature 1..9879: note = derived and/or modified CDS sequence (opt5) from DENV-1__HQ166035__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattagactgacagactacggcgccctcaccctggactgtagcccccggacaggccttgatttcaacgaaatggttctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggtcgtgctcggatctcaagagggcgctatgcacaccgccctgacaggggccacggaaatccagaccagcggaacaaccacaatttttgctggccatcttaaatgcagactgaagatggacaaactcaccctgaaggggacgtcctatgttatgtgtacaggcagcttcaaactggagaaggaagtggccgagacccagcacggaaccgtccttgtgcaggttaagtacgagggcacagatgcgccgtgcaaaatccctttctctacccaagacgaaaagggggtgacacagaacggacggctcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgccagaggcgctcgccggatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagcagatctacctcccttagcatgacatgtattgctgtgggcatggtcaccctctacctgggggtgatggttcaggccgactctggatgcgtgatcaactggaaaggccgcgaactgaagtgtgggtccggaattttcgtcacaaacgaggtgcacacctggacggaacaatataagtttcaggctgatagccctaaacggctctccgccgcgatcggcaaggcctgggaggagggggtttgcggcattagatctgctacacgcctggaaaatatcatgtggaaacagatcagcaacgagcttaatcatattctgctcgaaaacgacatgaagttcaccgtggtcgtgggagacgccaatggcatcctggctcaggggaaaaagatgattcggccgcaacccatggagcacaaatactcctggaagtcttggggaaaggccaaaatcattggcgccgatatccagaacaccacatttatcattgacgggcctgatacccccgaatgtcctgacaatcagagagcttggaacatctgggaggtggaggattatggattcggcatttttacgacaaatatctggctgaagcttcgcgacagctacacccagatgtgcgatcaccggctcatgtccgcggccattaaagacagcaaggctgtccatgccgatatgggctattggatcgaatctgagaaaaacgaaacatggaagctggccagagcttccttcatcgaggttaagacctgtacatggcccaaaagccacaccctgtggtctaatggggtgctcgaatccgagatgattatcccgaagatttacggaggccctatcagccaacataactatcgccccgggtacttcacgcagaccgccggaccttggcacctgggcaaacttgagctggactttgatctctgcgaagggacaaccgtggtcgtggacgagcactgcggaaatcggggcccctctctgagaacaaccacggttacaggcaagattatccatgaatggtgttgccggagctgtaccctgcctccccttcgcttcagaggggaggatggatgctggtacggcatggagatccggccggtgaaagaaaaggaggaaaacctcgtcagatccatggtgagcgcggggtctggagaggttgactcctttagcctgggcattctgtgtgtgtccatcatgattgaagaggtcatgcgctctcggtggagcagaaagatgctcatgacagggaccctggctgtgttccttctgctcgttatgggacagctgacctggaatgacctgatccgcctttgcattatggtgggcgccaacgcctccgatagaatgggcatggggacaacgtatctggctctcatggccacctttaaaatgcggcctatgttcgcggtcggactgctctttcgcagactgacatctcgggaggtgcttctgctcaccatcggcctgagcctggtggcttccgtcgaacttcccaactctctggaggaactcggggacggactggccatgggcattatgatgctcaagctgcttacagagttccaaccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccgcaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaggaagccgagcattccggcacctctcacaacattctggtggaagtccaagacgatgggacgatgaagatcaaagacgaggagagagatgacacccttacaattctgctcaaggccaccatgctggctgtgagcggagtttaccccatgtccatccctgcgacaccctttgtgtggtatttctggcagaaaaagaagcagcggatccgcgtcctctgggataccccgtctcctcccgaagtggagagagccgtcctggacgatggcatttaccggatccttcagcgcggcctgctggggagaagccaagtgggagttggcgtgttccaggacggggtctttcatacaatgtggcacgtgacgcggggagctgttctcatgtatcagggcaaaagactggaaccttcctgggcctctgtgaagaaagaccttattagctacgggggaggctggcgcttccagggctcctggaataccggggaggaggtccaagtgatcgccgtggaacccggaaagaacccgaaaaatgttcagacaacccctggcacctttaagacacccgagggggaagtcggagctattgccctggatttcaagcctggcacgagcgggtctcccatcgtgaaccgggaggaaaaaattgtgggactctacggcaatggcgtcgtgaccacatccgggacctatgttagcgcgatcgctcaggccaaggcctctcaagagggacccctgcctgagatcgaagacgaggtgtttaaaaagagaaacctcacaattatggatctgcacccgggctccgggaaaacccgccggtaccttcccgctatcgtcagagaagccattaagcgcaagctgcggacgctgatcctcgcgcctacaagagtggttgctagcgagatggccgaagccctgaaaggaatgcccattcgctatcagaccaccgctgtgaagtccgagcatacaggccgggagatcgtcgaccttatgtgccacgccaccttcacaatgagactgctctctcctgtgcgggttcccaattacaacatgatcattatggatgaagctcattttaccgaccctgccagcatcgcggcccgcgggtatatttccacgagagtgggcatgggagaggctgccgctatcttcatgacagccaccccgcccggcagcgtcgaagcctttcctcagtctaatgctgtgattcaggatgaggaacgggacatccccgagcgctcctggaacagcgggtacgattggatcacagacttccctggaaaaaccgtgtggtttgtcccctctattaagagcggcaatgatatcgcgaactgtctgagaaaaaacgggaagcgggttattcaactgtccagaaagacgttcgacaccgagtatcagaaaacaaagaataacgactgggattacgtggtgaccacagacatctctgaaatgggagccaatttccgcgctgatcgggtcattgacccgagacgctgcctcaaacctgtgatccttaaggatggccccgagcgggttattctggccgggcccatgcctgtgaccgtcgccagcgctgcccagagacgcggccggatcggaagaaaccagaataaagaaggcgaccaatacgtgtatatggggcagcccctgaacaatgatgaggaccacgcgcattggacagaggctaagatgctcctggataacatcaatacccctgaaggaattatcccggccctttttgagcccgaacgcgagaagtccgccgctattgacggcgaatacagactgcggggggaggcccgcaaaacgttcgttgagctcatgagacggggagatctgcctgtgtggctgtcttataaggtcgcgagcgaaggctttcagtactccgaccgcagatggtgcttcgatggggagcggaacaatcaggtgctcgaagagaacatggacgtcgaaatctggacaaaagagggcgagagaaagaaacttcgcccccggtggctggacgccagaacctatagcgatcctctggctctccgcgaatttaaggagttcgccgctggacggagatctgtgtccggcgacctgattcttgaaatcgggaaactgccccaacacctcaccctgcgggcccagaatgctctggataacctcgttatgcttcacaatagcgagcagggaggcaaggcctaccgccatgcgatggaagagctgccggacacaatcgagaccctgatgctcctggcccttattgctgtgctgacagggggagtgacgctctttttcctgtccggcaagggcctggggaaaacctctatcggactcctttgtgtcacagccagctccgctctgctgtggatggcctctgttgaacctcactggattgccgctagcatcattctcgagtttttcctgatggtgcttctgatccccgaacctgatagacagcggaccccccaagacaaccagctcgcgtatgtggtcatcggcctgctgtttatgattctcacagtggccgctaacgagatggggcttctggagaccacgaagaaagatctgggaatcggccatgttgccgccgaaaatcaccagcacgctaccatgctcgacgtggatctgcgccctgcctccgcgtggacactttacgccgtcgctaccacagtgattacccccatgatgagacatacgatcgagaacacaaccgccaatattagcctgacagctatcgccaaccaagcggccattctcatggggctggacaagggatggccgatctctaaaatggatatcggcgtccctctgctcgctcttggctgctactcccaggtgaatcccctgaccctgaccgccgctgttctcatgctggtggcccactatgctattatcgggcccggacttcaggccaaggcgacacgggaagcccagaagcgcacggctgccggcattatgaaaaaccctaccgtcgacgggatcgtggctattgatctggacccggttgtgtacgacgccaagttcgagaaacaactcggacagatcatgctgctgatcctctgtacaagccagattcttctgatgagaaccacatgggccctgtgcgaatctatcaccctcgcgacgggccccctgacaaccctttgggaggggtcccctggaaagttttggaataccacaattgctgtcagcatggccaacatcttccggggctcttatctggctggcgccgggctcgccttcagcctgatgaaatccctgggaggcgggcgcagaggaaccggcgctcagggggagacactcggagaaaagtggaagcggcaacttaatcagctgtctaaaagcgagtttaacacgtacaagagatccggcattatggaagtggatcgcagcgaggccaaagaaggcctgaagcggggggagaccacaaaacatgcggtgtccagaggaaccgccaagctccgctggttcgttgagcggaatctggtcaagcccgaaggcaaagtgatcgaccttgggtgtggaagaggcgggtggtcttattactgcgctggactgaagaaagtgacagaggtcaagggctataccaaaggcgggcctggacacgaagagcccatccctatggccacgtacggctggaacctcgttaagctgcatagcgggaaagatgtgtttttcatgccgcccgaaaagtgtgacaccctgctctgcgatattggagagtcctctcctaatcccacaatcgaggaaggccgcacccttcgggtgctgaagatggtcgagccttggctgagagggaaccagttttgtattaaaatcctcaatccctacatgccgagcgtggttgaagctctggagcagatgcaacgcaagcacggaggcatgcttgtgcggaaccctctgtccagaaattctacacacgagatgtattgggtcagctgcggcaccgggaacattgtgtccgccgttaacatgacaagccgcatgctcctgaatcggttcaccatggcgcatagaaaacccacgtacgaacgcgacgtggatctgggagccggcacaagacacgtcgctgtggagcccgaagtggccaacctcgacatcattgggcagcggatcgagaatatcaagaacgaacataaatctacctggcactatgatgaggacaatccttacaagacctgggcttatcacggatcctacgaggtcaagcccagcggctctgcctccagcatggttaacggggtggtgcgcctgcttacaaaaccttgggatgtcattccgatggtgacgcagatcgctatgaccgacacaaccccctttggacaacagagagttttcaaggaaaaagtggacacacggacccctagagccaagcggggcacaacccagattatggaggtcacggcgaaatggctgtggggctttctctctcgcaataagaagcccagaatctgtacccgggaagagttcacacgcaaagtgagatccaacgccgctattggggccgtttttgtggatgaaaatcagtggaacagcgctaaggaggccgtcgaggacgaacggttctgggatctggtgcatcgcgagagagaacttcacaaacaaggaaagtgcgccacctgcgtttataatatgatgggcaaacgggagaagaagctgggggaatttggaaaagcgaagggctcccgcgctatctggtacatgtggctcggggccagattcctggagttcgaggccctgggctttatgaacgaagaccattggttcagccgggagaattctctcagcggagtggaaggcgaggggctgcacaaacttggatacatcctgcgcgatatttccaagatccctggcgggaacatgtatgctgacgatacagccggatgggacaccagaattacggaggatgacctccagaatgaagctaaaatcacagagattatggaacccgagcatgccctgcttgcgacctctatctttaagctgacataccagaacaaagtcgtgcgggtccagcgcccggccaagaacggcaccgtgatggatgttatcagcagacgggaccaaagagggtccggccaggtgggaacgtatggcctcaataccttcacaaacatggaagtccagctgattcgccagatggagtctgaggggatctttctgcctagcgaactcgagacccccaatctggctgaacgggtgcttgattggctggagaagcacggagccgaaagactcaaacgcatggctatttccggcgacgactgtgtggttaagcctatcgatgaccggttcgccacagcgctgaccgcccttaacgatatggggaaagtgagaaaggacattccccaatgggagccttctaaaggatggaatgattggcagcaggtccccttttgcagccaccatttccaccagctgatcatgaaggacggccgcgagatcgtggttccgtgtcggaaccaagatgaactcgtggggagagctcgcgtctcccagggcgccggatggagcctgcgggagacagcttgcctgggcaagtcttacgcccagatgtggcaactcatgtattttcatagacgcgacctgcggcttgctgccaatgcgatttgttccgccgtgcctgtcgattgggtgcccaccagcagaacgacatggtctatccacgctcaccatcagtggatgaccaccgaagacatgctgtccgtttggaaccgggtgtggattgaggaaaatccctggatggaggataaaacacacgtcagctcctgggaggaagtgccttacctcgggaagagagaggaccagtggtgcggatctctgatcggccttaccgcccgcgccacatgggctacgaacattcaggttgccatcaatcaagtgcggagactgattgggaacgaaaattatctcgactacatgaccagcatgaaacgcttcaagaacgagtccgatccggagggagcgctgtggtga

SEQ ID NO: 18603 - RNA, 9879 nt, synthetic construct
  misc_feature 1..9879: note = derived and/or modified CDS sequence (opt5) from DENV-1__GQ868502__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaaccatcttcattctgcttatgctggctacacctagcatggccatgcgctgcgtcggcatcgggaacagagattttgtggagggactctccggcgctacgtgggttgacgtggtcctggagcacgggagctgtgtgaccacaatggccaagaataaacccaccctggatattgaactcctgaagacagaggtgaccaaccctgcgatccttcggaaactgtgcattgaagccaagatctctaatacgacaaccgactcccgctgtccgacccagggagaggctacactcgtcgaagagcaggatgccaacttcgtttgcagacggacctttgtggaccgcggctggggcaatgggtgtggactgttcggcaaagggagccttctgacatgcgctaagtttaagtgcgtgacgaaactcgagggaaagaccgtccagtacgaaaacctgaaatattctgtgattgttacagtgcacaccggcgatcaacatcaggtcgggaatgagacaaccgaacacggaacgatcgccaccatcacaccccaggcccctacctccgagattcagctgacagactacggcgctctcaccctggactgtagccccagaacgggccttgatttcaacgaaatggtgctgctcacaatgaaggagaaatcttggctggttcataagcaatggtttcttgacctgcctctcccctggacctccggggcgagcacatcccaggagacctggaatcggcaggatctgctggtgaccttcaaaacagcccacgctaagaagcaagaagtcgtggtcctcggatctcaggagggcgccatgcacacggccctgaccggggctacagaaatccagaccagcggaacaaccacgatttttgccggccatcttaaatgccgcctgaagatggacaaactcacactgaaggggacctcctatgtgatgtgtaccggcagcttcaaactggagaaggaagttgcggagacacagcacggaaccgtgcttgtccaagtgaagtacgagggcacagatgctccgtgcaaaatccctttctctacgcaggacgaaaagggggttacccagaacggaagactcattacagccaatcccatcgtgaccgataaagagaagcctgtcaacatcgaaacagagcccccctttggcgagtcctatattgtggtgggggccggagaaaaagctctgaagctgagctggttcaagaaaggctctagcatcgggaagatgtttgaggccaccgctcggggcgccagacgcatggcgattctcggagacacggcctgggatttcggctccatcgggggagtttttacctctgtcggcaaactggtgcatcaggtgttcgggacagcttacggagtcctttttagcggcgtgtcctggaccatgaagattgggatcggcatcctgctcacatggctgggactgaatagccggtctacctcccttagcatgacatgtattgccgttggcatggtgaccctctacctgggggtcatggtgcaagctgactctggatgcgttatcaactggaaaggcagagaactgaagtgtgggtccggaattttcgtgacgaacgaggtccacacatggaccgaacagtataagtttcaggccgatagccctaaacgcctctccgcggccatcggcaaggcttgggaggagggggtgtgcggcattcggtctgccaccagactggaaaatatcatgtggaaacagattagcaacgagcttaatcatatcctgctcgaaaacgacatgaagttcacagttgtggtcggagacgctaatggcatcctggcccaagggaaaaagatgattcgcccgcagcccatggagcacaaatactcctggaagtcttggggaaaggccaaaatcattggcgctgatatccagaacaccacgtttattatcgacgggcctgatacacccgaatgtcctgacaatcagcgggcgtggaacatctgggaggtggaggattatggattcggcatttttaccacaaatatctggctgaagcttagagacagctacacccaaatgtgcgatcaccgcctcatgtccgccgctattaaagacagcaaggccgtgcatgccgatatgggctattggatcgaatctgagaaaaacgaaacatggaagctggctcgggcctccttcattgaggtcaagacctgtacgtggcccaaaagccacaccctgtggtctaatggggttctcgaatccgagatgatcatcccgaagatttacggaggccctatcagccagcataactatagacccgggtacttcacacagaccgcgggaccttggcacctgggcaaacttgagctggactttgatctctgcgaagggacaaccgtggtggtcgacgagcactgcggaaatcgcggcccctctctgcggacgacaaccgtgacaggcaagattatccatgaatggtgttgcagaagctgtaccctgcctccccttcggttccgcggggaggatggatgctggtacggcatggagattagaccggttaaagaaaaggaggaaaacctcgtgcggtccatggtcagcgctgggtctggagaggtggactcctttagcctgggcatcctgtgtgcctccatcatgattgaagaggttatgagatctcgctggagccggaagatgctcatgaccgggacactggccgtgttccttctgctcgtcatgggacaactgacgtggaatgacctgatcagactttgcattatggtgggcgctaacgcctccgatcgcatgggcatggggaccacatatctggcgctcatggctacctttaaaatgagacctatgttcgccgttggactgctctttcggcgcctgacatctagagaggtgcttctgctcaccatcggcctgagcctggtcgcctccgtggaacttcccaactctctggaggaactcggggacggactggctatgggcattatgatgctcaagctgcttacggagttccagccccaccagctgtggacaaccctcctgagcctgacctttatcaaaacaaccctttccctggattacgcctggaagacaacggctatggccctcagcattgtgtctctgttccctctctgtctgtccaccacaagccagaaaaccacatggcttccggtcctgctggggtcttttggatgcaagcccctcaccatgttcctgatcacggaaaataagatctggggccggaaatcctggcctcttaacgagggcattatggcgatcgggattgttagcatcctgctctcttccctgctcaagaatgacgtgcccctggccggacctcttattgctggcgggatgctgatcgcctgttatgtgatcagcggatccagcgctgatctgtctctcgagaaagccgccgaagtcagctgggagcaagaagctgagcattccggcacctctcacaacattctggtggaagttcaggacgatgggacaatgaagatcaaagacgaggagcgcgatgacacccttacaattctgctcaaggcgaccctgctcgccgtgagcggagtctaccccatgtccatccctgctacactgtttgtgtggtatttctggcagaaaaagaagcagagatctggcgttctttgggatacgcccagcccgcctgaagtggagcgggccgtcctggacgatggcatttaccgcatcctgcaaagagggctcctgggacggtcccaggtgggcgtcggggtgttccaggacggagtttttcataccatgtggcacgtgacacgcggcgccgtccttatgtatcaggggaaaagactggaaccctcttgggctagcgtgaagaaagacctcatctcctacggaggcggctggcggttccaagggagctggaataccggagaggaggttcaggtgattgccgtcgaacctggcaagaaccccaaaaatgtgcagaccacaccggggacgtttaagacccctgagggagaagtgggcgcgatcgctctggatttcaagcccgggacatctggatcccctattgttaacagagagggcaaaatcgtcggcctctacgggaatggagtggtgaccacaagcggcacctatgtctctgccattgcccaagctaaggcctcccaggaagggcccctgcccgagatcgaggacgaagtgtttaaaaagcgcaaccttacgattatggatctgcaccctggaagcggcaaaacacggagatacctgccggcgatggttcgcgaggctatcaagcggaagctcagaaccctgatccttgcccccacccgcgtggtcgcctccgaaatggctgaggccctgaaagggatgcctattcggtatcagacaaccgctgtgaagtctgaacatacaggcagagagatcgttgacctcatgtgccacgccaccttcacgatgcgcctgctgagccccgtgcgggtccctaattacaacatgattatcatggatgaggcgcattttacagaccccgcctccattgctgccagaggatatatcagcacccgggtgggcatgggggaagctgccgccatcttcatgacagctacccctccgggatctgttgaggcgtttccccagtccaatgccgtgattcaagatgaagagcgcgacatccctgaaagaagctggaactctggctacgattggattacggacttccccgggaaaaccgtctggtttgtgcctagcatcaagtccggaaatgatattgctaactgtctccggaaaaacggcaagcgcgtgatccagctttctagaaagacattcgacaccgagtatcagaaaacaaagaataacgactgggattacgtcgttaccacagacatcagcgagatgggggccaatttccgggccgatagagtgattgacccccgccggtgcctgaaaccggtgatcctgaaggatggccctgaaagagtcattctcgctggacccatgcccgtgaccgttgcctccgcggctcagcgccggggcagaatcgggcgcaaccaaaataaagagggagaccagtacgtgtatatgggccagcctctgaacaatgatgaagaccacgcccattggacggaggccaagatgcttctggataacattaatacacccgaggggatcattcctgctctctttgaaccggagcgggaaaagtctgccgcgatcgacggagagtacagactgcgcggcgaagccagaaaaaccttcgtcgagctgatgcggcgcggggatctccccgtgtggcttagctataaggttgcttccgagggctttcagtacagcgacagacggtggtgcttcgatggagaacgcaacaatcaagtgctggaggaaaacatggacgtcgagatctggaccaaagaaggcgagagaaagaaactgcggcctagatggctcgacgcccgcacatattctgatcccctggctcttcgggagtttaaggaattcgccgctgggagacgctccgtgagcggagacctgattctcgagatcggcaaactgcctcagcacctgaccctccgggcccagaatgcgcttgataacctggtcatgctgcacaattccgaacaggggggaaaggcctacagacatgctatggaggaactccccgacacaattgagacgctgatgcttctggccctcatcgctgtgctgaccggcggcgttacactgtttttcctctctgggaagggacttggcaaaaccagcattgggctgctgtgtgtgacagcctcctctgccctcctgtggatggctagcgtggagccgcactggatcgcggcctccatcattcttgaatttttcctgatggtcctcctgatccctgagcccgatcggcaacgcacccctcaggacaaccagctggcttatgttgtgattggactcctttttatgatcctgacggtggccgccaacgaaatgggcctgctcgagaccacaaagaaagatctggggattggacatgtcgctgccgagaatcaccaacacgcgaccatgcttgacgtggatctgagacccgccagcgcttggacactctacgccgttgctaccacggtgatcacacctatgatgcggcataccatcgaaaacacaaccgccaatatttctctgaccgcgatcgccaaccaggctgccattctgatgggcctcgacaagggctggcccatctccaaaatggatattggggtcccgcttctggctctgggatgctacagccaggtgaatcctctcacactgacggccgctgtccttatgctggtggcccactatgcgatcattggccccgggctccaggccaaggctacccgcgaggcccaaaagagaacagctgccggaatcatgaaaaaccccaccgttgacggcatcgtggccattgatctggaccctgtcgtgtacgacgcgaagttcgaaaaacagctggggcagatcatgctccttattctgtgtacatctcagatcctgctcatgcggaccacgtgggctctgtgcgagtccattacacttgccaccggaccgctgaccacactctgggaaggcagccccggcaagttttggaataccacaatcgctgtttctatggccaacatcttccgcgggagctatctggccggagctggcctggccttctccctcatgaaatctcttgggggaggcagacgggggacgggagcgcaaggcgagaccctgggcgagaagtggaagcgccagctgaatcagctcagcaaatccgaatttaacacatacaagagaagcgggattatggaggtggatcggtccgaagccaaagagggactgaagagaggcgaaaccacaaaacatgctgtctctcgcgggaccgccaagcttcggtggttcgtggagagaaatctggtgaagcctgagggaaaagttatcgacctcggctgtgggcgcggaggctggagctattactgcgctggcctgaagaaagtcacggaagtgaaggggtataccaaaggaggccccgggcacgaggaacctattcccatggccacatacggatggaacctggtgaagctccattccggcaaagatgtctttttcatgcctccggagaagtgtgacacccttctgtgcgatatcggggaatctagccccaatcctacaattgaggagggacggaccctgagagttctcaagatggtggaaccctggctgcgcggcaaccagttttgtatcaaaatccttaatccttacatgccctccgtggtcgagacactggaacaaatgcagcggaagcacggcgggatgctcgtgagaaacccgctgtctcgcaatagcacccacgagatgtattgggtttcctgcggaacgggcaacattgtgagcgcggtcaacatgacatctcggatgctgctcaatagattcaccatggcccatcgcaaacctacctacgagcgggacgtggatctgggggctggaacaagacacgttgccgtggaacccgaggtcgctaaccttgacatcattggccagcgcatcgaaaatattaagaacgagcataaatccacgtggcactatgatgaagacaatccctacaagacctgggcctatcacgggagctacgaggtgaagccttctggatccgctagctctatggtgaacggcgtcgttagactgctcacaaaaccctgggatgtgatccctatggtgacccaaattgccatgacagacaccacaccgtttggccagcagcgggtcttcaaggagaaagtggacacccgcacgcccagagcgaagcgggggaccacacagatcatggaagttaccgccaaatggctgtggggatttctttccagaaataagaagcctcggatctgtacacgcgaggaattcaccagaaaagtgcggagcaacgctgccattggcgctgtctttgtggatgagaatcaatggaactccgccaaggaagccgttgaggacgagcgcttctgggatctggtgcatagagaacgggagctccacaaacaggggaagtgcgcgacgtgcgtctataatatgatgggaaaacgcgaaaagaagctgggcgagtttgggaaagctaagggcagcagagccatctggtacatgtggctgggagcccggttcctcgaattcgaggctctgggctttatgaacgaggaccattggttctctcgcgaaaatagcctttccggggtggagggagaaggcctgcacaaactcgggtacattctgagagatatctctaagattcccggaggcaacatgtatgccgacgatacagctgggtgggacacccggatcacagaggatgaccttcagaatgaggccaaaatcaccgaaattatggagcctgaacatgcgctgctcgccacgagcatctttaagctgacctaccagaacaaagttgtgcgcgtccaaagacccgctaagaacggcacagtgatggatgtcatttcccggcgcgaccagagaggatctggccaggtggggacctatggactgaatacattcaccaacatggaggttcagctcatccggcaaatggaaagcgagggcatttttctgccgtccgagcttgaaacacctaatctggccgagagagtgctcgattggctggaaaagcacggggctgagcgccttaaacggatggccatctctggagacgactgtgtcgtgaagcccatcgatgacagattcgcgaccgccctgacggctctcaacgatatgggcaaagtgcgcaaggacattcctcagtgggaacccagcaaagggtggaatgattggcagcaggttcctttttgctcccaccatttccaccaactgatcatgaaggacggccgggagattgtggtcccctgtagaaaccaggatgagctggtgggacgcgcccgggttagccagggcgctgggtggtctctcagagaaacagcctgcctgggaaagtcctacgctcaaatgtggcagcttatgtattttcatcgccgggacctgagactcgccgcgaatgccatctgtagcgctgtgccggtcgattgggtgcctacctctcgcaccacatggtccattcacgcccaccatcagtggatgaccacagaggacatgctgagcgtctggaaccgggtgtggatcgaagagaatccctggatggaagataaaacgcacgtttcctcttgggaggaggtgccctaccttggcaagagagaagaccagtggtgcgggagcctgatcggactcaccgcccgggctacatgggccaccaacattcaagtcgcgatcaatcaggtgagacgcctgattggcaacgagaattatctggactacatgacatccatgaaacggttcaagaacgaaagcgatcctgagggggctctctggtga

SEQ ID NO: 18604 - RNA, 9879 nt, synthetic construct
  misc_feature 1..9879: note = derived and/or modified CDS sequence (opt5) from DENV-1__GQ868503__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccagaacgaaaagggggtgacacagaatggaagactcatcacggctaaccccattgtcaccgacaaagagaagcctgtgaatatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagatacagcgtgggacttcggctccatcgggggagtctttacctctgtgggcaaactggtgcatcaggtcttcgggacggcctacggagtgctttttagcggcgtttcctggaccatgaagatcgggattggcatcctgctcacatggctgggactgaacagccggtctacctcccttagcatgacatgtattgctgtgggcatggtcaccctctacctgggggtgatggttcaagccgattctggatgcgtgatcaactggaaaggcagagaactgaagtgtgggtccggaattttcgtcacaaatgaggtgcacacctggacggaacagtataagtttcaggctgacagccctaaacgcctctccgccgcgatcggcaaggcctgggaggagggggtttgcggcattcggtctgctacaagactggaaaacatcatgtggaaacagatcagcaatgagcttaaccatattctgctcgaaaatgatatgaagttcaccgtggtcgtgggagacgccaacggcatcctggctcaagggaaaaagatgattcgcccgcagcccatggagcacaaatactcctggaagtcttggggaaaggccaaaatcattggcgccgacatccagaataccacatttatcattgatgggcctgacacccccgaatgtcctgataaccagcgggcttggaatatctgggaggtggaggactatggattcggcatttttacgacaaacatctggctgaagcttagagatagctacacccaaatgtgcgaccaccgcctcatgtccgcggccattaaagatagcaaggctgtccatgccgacatgggctattggatcgaatctgagaaaaatgaaacatggaagctggagcgggcctccttcatcgaagttaagacctgtacatggcccaaaagccacaccctgtggtctaacggggtgctcgagtccgagatgattatcccgaagatttacggaggccctatcagccagcataattatagacccgggtacttcacgcagaccgctggaccttggcacctgggcaaacttgaactggattttgacctctgcgaggggacaaccgtggtcgtggatgaacactgcggaaaccgcggcccctctctgcggacaaccacggttacaggcaagattatccatgagtggtgttgcagaagctgtaccctgcctccccttcggttccgcggggaggacggatgctggtacggcatggaaatcagaccggtgaaagagaaggaagagaatctcgtccggtccatggtgagcgccgggtctggagaagttgattcctttagcctgggcattctgtgtgcgtccatcatgattgaggaggtgatgagatctcgctggagccggaagatgctcatgacagggaccctggctgtcttccttctgctcatcatgggacaactgacctggaacgacctgattagactttgcatcatggtgggcgccaacgcctccgaccgcatgggcatggggacaacgtatctggctctcatggccacctttaaaatgagacctatgttcgcggttggactgctctttcggcgcctgacatctagagaagtgcttctgctcaccattggcctgagcctggtcgcttccgtggagcttcccaattctctggaagagctcggggatggactggccatgggcatcatgatgctcaagctgcttacagaattccagccccaccagctgtggaccacgctcctgagcctgacatttatcaaaaccaccctttccctggactacgcctggaagacaaccgctatggccctcagcattgtgtctctgttccctctctgtctgtccacaacgagccagaaaaccacatggcttccggtcctgctggggtcttttggatgcaagcccctcaccatgttcctgatcacagagaacaagatttggggccggaaatcctggcctcttaatgagggcatcatggctattgggatcgttagcatcctgctctcttccctgctcaagaacgatgtgcccctggccggacctcttattgcgggcgggatgctgatcgcctgttatgtgattagcggatccagcgctgacctgtctctcgaaaaagccgctgaggtcagctgggaacaagaggccgaacattccggcacctctcacaatatcctggtggaggttcaggatgacgggacgatgaagattaaagatgaggaacgcgacgatacccttacaatcctgctcaaggccaccctgctcgctgtgagcggagtctaccccatgtccatccctgcgacactgtttgtgtggtatttctggcagaaaagaaagcagcggtctggcgttctttgggacacccccagcccgcctgaggtggaacgcgccgtcctggatgacggcatttacagaatcctgcaacgggggctcctgggacgctcccaggtgggcgtcggggtgttccaggatggagtttttcatacaatgtggcacgtgacgagaggcgctgtccttatgtatcaggggaagcggctggagccctcttgggccagcgtgaaaaaggacctcatttcctacggaggcggctggagattccaagggagctggaacaccggagaggaagttcaggtgatcgccgtcgagcctggcaaaaatcccaagaacgtgcagacaaccccggggatttttaaaacccctgaaggagaggtgggcgctatcgccctggacttcaagcccgggacatctggatcccctattgttaatcgcgaaggcaagatcgtcggcctctacgggaacggagtggtgacgaccagcggcacatatgtctctgcgatcgctcaagccaaagcctcccaggaggggcccctgcccgagattgaagatgaggtgtttaagaaacggaatcttaccatcatggacctgcaccctggaagcggcaagacaagacgctacctgccggctattgttcgggaagccatcaaaagaaagctccgcaccctgattcttgcgcccacgcgggtggtcgcttccgagatggccgaagccctgaaggggatgcctatcagatatcagacaaccgctgtgaaatctgagcataccggccgcgagatcgttgatctcatgtgccacgccacattcaccatgcggctgctgagccccgtgagagtccctaactacaatatgattatcatggacgaagctcattttacagatcccgcctccattgcggcccggggatatatcagcacccgcgtgggcatgggggaggctgccgctattttcatgacggccacacctccgggatctgttgaagcctttccccagtccaacgctgtgatccaagacgaggaaagagatatccctgagcggagctggaattctggctacgactggattaccgatttccccgggaagacagtctggtttgtgcctagcatcaaatccggaaacgacattgcgaactgtctccgcaagaatggcaaaagagtgatccagctttctcggaagaccttcgatacggagtatcagaagaccaaaaacaatgactgggactacgtcgttacaaccgatattagcgaaatgggggccaacttcagagctgaccgcgtgatcgatccccggagatgcctgaagccggtgattctgaaagacggccctgagcgcgtcatcctcgccggacccatgcccgtgacagttgcctccgctgcccagcggagaggccgcatcgggcggaatcaaaacaaggaaggagatcagtacgtgtatatgggccagcctctgaataacgacgaggatcacgcgcattggaccgaggctaaaatgcttctggacaatattaacacacccgaagggatcattcctgccctctttgagccggaaagagagaagtctgccgctatcgatggagaataccgcctgagaggcgaggcccggaagaccttcgtcgagctgatgcgcagaggggacctccccgtgtggcttagctataaagttgcgtccgaaggctttcagtacagcgatcggcgctggtgcttcgacggagagagaaataaccaagtgctggaagagaatatggatgtcgaaatttggacgaaggagggcgagcggaaaaagctgagacctcgctggctcgacgcccggacatattctgaccccctggctcttagagaatttaaagagttcgccgctgggcgccggtccgtgagcggagatctgatcctcgaaatcggcaagctgcctcagcacctgaccctcagagcccagaacgctcttgacaatctggtcatgctgcacaactccgagcaggggggaaaagcctaccggcatgcgatggaagagctccccgataccattgagacactgatgcttctggccctcatcgctgtgctgaccggcggcgttacactgtttttcctctctgggaagggacttggcaagacgagcattgggctgctgtgtgtgaccgcctcctctgctctcctgtggatggccagcgtggaaccgcactggatcgccgcttccattatccttgagtttttcctgatggtcctcctgatccctgaacccgaccgccaaagaacacctcaggataaccagctggcgtatgttgtgattggactcctttttatgatcctgaccgtggccgctaatgagatgggcctgctcgagacaaccaaaaaggacctggggattggacatgtcgccgccgaaaaccaccaacacgctacgatgcttgatgtggacctgcggcccgccagcgcgtggaccctctacgccgttgctacaaccgtgatcacacctatgatgcgccataccattgagaatacgacagccaacatctctctgaccgctattgccaatcaggcggccatcctgatgggcctcgataaaggctggcccatctccaagatggacattggggtcccgcttctggctctgggatgctacagccaggtgaaccctctcacactgaccgccgctgtccttatgctggtggcccactatgctatcattggccccgggctccaggccaaagcgaccagagaagcccaaaagcggacagctgccggaatcatgaagaatcccacggttgatggcattgtggctatcgacctggatcctgtcgtgtacgacgccaaattcgagaagcagctggggcagatcatgctccttattctgtgtacctctcagatcctgctcatgcgcacaacctgggccctgtgcgaatccattacacttgcgaccggaccgctgacgacactctgggagggcagccccggcaaattttggaacaccaccatcgctgtttctatggccaatattttcagagggagctatctggctggagccggcctggccttctccctcatgaagtctcttgggggaggccggcgcgggacaggagctcaaggcgagaccctgggcgaaaaatggaagagacagctgaaccagctcagcaagtccgagtttaatacatacaaacggagcgggatcatggaagtggacagatccgaggccaaggaaggactgaaacgcggcgagacgaccaagcatgcggtctctcgggggacagccaaacttagatggttcgtggagcgcaacctggtgaagcctgaaggaaaggttatcgatctcggctgtgggcggggaggctggagctattactgcgctggcctgaaaaaggtcaccgaggtgaaagggtatacaaagggaggccccgggcacgaagagcctattcccatggccacctacggatggaatctggtgaaactccattccggcaaggacgtctttttcatgcctccggaaaaatgtgatacgcttctgtgcgacatcggggagtctagccccaaccctaccattgaggaaggaagaacactgcgcgttctcaagatggtggagccctggctgcggggcaatcagttttgtatcaagattcttaacccttacatgccctccgtggtcgaaaccctggagcaaatgcagagaaaacacggcgggatgctcgtgcgcaatccgctgtctcggaacagcacacacgagatgtattgggtttcctgcggaaccggcaacatcgtgagcgctgtcaatatgacatctagaatgctgctcaaccgcttcaccatggcccatcggaagcctacgtttgaaagagatgtggacctgggggcgggaacacgccacgttgccgtggagcccgaagtcgctaatcttgatattatcggccagagaatcgagaacattaaaaatgaacataagtccacctggcactacgacgaggataacccctataaaacctgggcctaccacgggagctatgaggtgaagccttctggatccgctagctctatggtgaatggcgtcgttcggctgctcacaaagccctgggacgtgatccctatggtgacgcaaattgccatgaccgatacaaccccgttcggccagcagcgcgtctttaaagaaaaggtggacacaagaaccccccgggctaaaagagggacaacccagatcatggaggttacggccaagtggctgtggggattcctttcccggaacaaaaagcctcgcatttgtaccagagaagagtttacacggaaggtgcgcagcaatgcggccatcggcgctgtcttcgtggacgaaaaccaatggaattccgccaaagaggctgttgaggatgaaagattttgggacctggtgcatcgggagcgcgaactccacaagcaggggaaatgcgccacctgcgtctacaacatgatgggaaagagagagaaaaagctgggcgaattcgggaaggccaaaggcagccgggcgatctggtatatgtggctgggagctcgcttcctcgagtttgaggccctgggcttcatgaatgaagatcattggttttctagagagaacagcctttccggggtggaaggagagggcctgcacaagctcgggtacattctgcgggacatctctaaaattcccggaggcaatatgtacgccgatgacacagctgggtgggatacccgcatcacggaggacgatcttcagaacgaagccaagattacagacatcatggagcctgaacatgctctgctcgccaccagcatcttcaaactgacatatcagaacaaggttgtgagagtccaacggcccgcgaaaaatggcaccgtgatggatgtcatttcccgcagagaccagcggggatctggccaggtggggacgtacggactgaacacctttacaaatatggaggttcagctcatcagacaaatggaaagcgagggcattttcctgccgtccgagcttgaaacccctaacctggccgagcgcgtgctcgattggctggaaaagcacggggctgagcggcttaagagaatggccatctctggagacgactgtgtcgtgaaacccattgatgaccgctttgctacagccctgaccgcgctcaatgatatgggcaaggtgcggaaagacatccctcagtgggaacccagcaaggggtggaacgattggcagcaggttcctttctgctcccaccattttcaccaactgatcatgaaagacggcagagagattgtggtcccctgtcgcaatcaggatgagctggtgggacgggccagagttagccagggcgctgggtggtctctccgcgaaacagcctgcctgggaaagtcctatgctcaaatgtggcagcttatgtacttccatcggagagacctgcgcctcgccgctaacgccatctgtagcgcggtgccggtcgattgggtgcctacctctcggacgacatggtccattcacgcccaccatcagtggatgaccaccgaggacatgctgagcgtctggaatagagtgtggatcgaagagaacccctggatggaagataagacacacgtttcctcttgggaggaggtgccctatcttggcaaacgggaagaccagtggtgcgggagcctgattggactcaccgctagagccacatgggccacgaatatccaagtcgctattaaccaggtgcgccggctgatcggcaatgagaactacctggactatatgacctccatgaagagatttaaaaatgaaagcgatcctgagggggccctctggtga

SEQ ID NO: 18605 - RNA, 9879 nt, synthetic construct
  misc_feature 1..9879: note = derived and/or modified CDS sequence (opt5) from DENV-1__GQ868504__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagggcgaacatacaggaagagagattgtcgacctcatgtgccacgccaccttcacaatgcgcctgctgtctcccgtgcgggttcctaattacaacatgatcatcatggatgaggctcattttaccgaccccgccagcattgcggccagaggctatatctccacgcgggtggggatgggagaagctgccgctattttcatgacagccacccctccgggcagcgtcgaggcctttccccagtctaatgctgtgatccaagatgaagagcgcgacattcctgaaagatcctggaacagcgggtacgattggatcacagacttccccggaaaaaccgtgtggtttgtcccttctatcaagagcggcaatgatattgcgaactgtctccggaaaaacgggaagcgcgttatccagctttccagaaagacgttcgacaccgagtatcagaaaacaaagaataacgactgggattacgtggtgaccacagacatttctgagatgggcgccaatttccgggctgatagagtcatcgacccccgccggtgcctgaaaccggtgattctgaaggatggacctgaaagagttatcctcgccggccccatgcccgtgaccgtcgccagcgctgcccagcgccgggggagaattggacgcaaccaaaataaagagggcgaccagtacgtgtatatggggcagcctctgaacaatgatgaagaccacgcgcattggacagaggctaagatgcttctggataacatcaatacccccgagggaatcattcctgccctctttgaaccggagcgggaaaagtccgccgctatcgacggcgagtacagactgcgcggggaagccagaaaaacgttcgttgagctgatgcggcgcggcgatctccccgtgtggctttcttataaggtcgcgagcgagggatttcagtaccctgacagacggtggtgcttcgatggcgaacgcaacaatcaagtgctggaggaaaacatggacgtcgagatttggacaaaagaaggggagagaaagaaactgcggcccagatggctcgacgcccgcacctattccgatcctctggctcttcgggagtttaaggaattcgccgctggaagacgcagcgtgtctggcgacctgatcctcgagattgggaaactgccccagcacctgaccctccgggcccagaatgctcttgataacctggttatgctgcacaattccgaacagggaggcaaggcctacagacatgcgatggaggaactcccggacacaatcgagaccctgatgcttctggccctcatcgctgtgctgacaggcggggtgacgctgtttttcctcagcggaaagggccttgggaaaacctccattggactgctgtgtgtcacagcctctagcgctctcctgtggatggcctccgttgagcctcactggatcgccgcttctattatccttgaatttttcctgatggtgctcctgattcccgagcctgatcggcaacgcaccccccaggacaaccagctggcgtatgtggtcatcggcctcctttttatgatcctgacagtggccgctaacgaaatggggctgctcgagaccacgaagaaagatctgggaattggccatgttgccgccgagaatcaccaacacgctaccatgcttgacgtggatctgagacctgccagcgcgtggacactctacgccgtcgctaccacagtgatcacccccatgatgcggcatacgattgaaaacacaaccgccaatatctccctgacagctattgccaaccaggcggccatcctgatgggcctcgacaaggggtggccgattagcaaaatggatatcggagtccctcttctggctctgggctgctactctcaggtgaatcccctcaccctgaccgccgctgttcttatgctggtggcccactatgctatcattgggcccggactccaggccaaggcgacacgcgaggcccaaaagagaacggctgccggcatcatgaaaaaccctaccgtcgacgggattgtggctatcgatctggacccggttgtgtacgacgccaagttcgaaaaacagctgggacagattatgctccttatcctgtgtacatcccagatcctgctcatgcggaccacatgggccctgtgcgagagcattacccttgcgacgggccccctgacaaccctctgggaaggctctcctgggaagttttggaataccacaatcgctgtctccatggccaacattttccgcggaagctatctggctggcgccgggctggccttctctctcatgaaaagccttggaggcgggagacggggaaccggcgctcaaggcgagacactgggggagaagtggaagcgccagctgaatcagctctccaaatctgaatttaacacgtacaagagaagcggaatcatggaggtggatcggtccgaagccaaagagggcctgaagagaggggaaaccacaaaacatgcggtgagccgcggaaccgccaagcttcggtggttcgttgagagaaatctggtcaagcccgagggcaaagtgattgacctcgggtgtggacgcggcggctggtcctattactgcgctgggctgaagaaagtgacagaagtcaagggatataccaaaggcgggcctggacacgaggaacccatccctatggccacgtacggctggaacctggttaagctccattctgggaaagatgtgtttttcatgccgcccgagaagtgtgacacccttctgtgcgatatcggagaaagctcccctaatcccacaattgaggagggccggaccctgagagtgctcaagatggtcgaaccttggctgcgcggcaaccagttttgtatcaaaattcttaatccctacatgccgtctgtggttgaggctctggaacaaatgcagcggaagcacgggggaatgctcgtgagaaaccctctgagccgcaattccacacacgagatgtattgggtctcttgcggcaccgggaacatcgtgagcgccgttaacatgacatcccggatgctgctcaatagattcaccatggcgcatcgcaaacccacgtacgagcgggacgtggatctgggagccggcacaagacacgtcgctgtggaacccgaggtggccaaccttgacattatcgggcagcgcattgaaaatatcaagaacgagcataaaagcacctggcactatgatgaagacaatccttacaagacctgggcttatcacggatcttacgaggtcaagccctccggcagcgcctcttccatggttaacggcgtggtgagactgctcacaaaaccttgggatgtcatcccgatggtgacgcaaattgctatgaccgacacaaccccctttgggcagcagcgggttttcaaggagaaagtggacacacgcacccctagagccaagcggggaacaacccagatcatggaagtcacggcgaaatggctgtggggctttcttagcagaaataagaagccccggatttgtacccgcgaggaattcacaagaaaagtgcggtctaacgccgctatcggggccgtttttgtggatgagaatcaatggaactccgctaaggaagccgtcgaggacgagcgcttctgggatctggtgcatagagaacgggagctccacaaacagggaaagtgcgccacctgcgtttataatatgatgggcaaacgcgaaaagaagctgggggagtttggcaaagcgaagggaagcagagctatttggtacatgtggctgggcgcccggttcctcgaattcgaggccctggggtttatgaacgaggaccattggttctcccgcgaaaatagcctttctggagtggagggcgaagggctgcacaaactcggatacatcctgagagatatcagcaagattcctggcgggaacatgtatgctgacgatacagccggctgggacacccggatcacggaggatgaccttcagaatgaggctaaaattacagaaatcatggagcccgaacatgccctgctcgcgacctccatttttaagctgacataccagaacaaagtcgtgcgcgtccaaagaccggccaagaacggaaccgtgatggatgttatctctcggcgcgaccagagaggcagcgggcaggtgggaacgtatggcctgaataccttcacaaacatggaggtccagctcatccggcaaatggaatccgaggggatttttctgccttctgagcttgaaacccccaatctggctgagagagtgctcgattggctggaaaagcacggagccgagcgccttaaacggatggctatcagcggcgacgactgtgtggttaagcctattgatgacagattcgccacagcgctgaccgccctcaacgatatggggaaagtgcgcaaggacatcccccagtgggaaccttccaaaggctggaatgattggcagcaggtccccttttgctctcaccatttccaccaactgattatgaaggacggacgggagatcgtggttccgtgtagaaaccaggatgagctggtgggccgcgctcgggtcagccagggggccggatggtccctcagagaaacagcttgcctgggcaagagctacgcccaaatgtggcagcttatgtattttcatcgccgggacctgagactcgctgccaatgcgatctgttctgccgtgcctgtcgattgggtgcccacctcccgcacgacatggagcattcacgctcaccatcagtggatgaccaccgaggacatgctgtctgtttggaaccgggtgtggatcgaagagaatccctggatggaagataaaacacacgtctccagctgggaggaggtgccttaccttgggaagagagaagaccagtggtgcggatccctgattggcctcaccgcccgggccacatgggctacgaacatccaagttgccattaatcaggtgagacgcctgatcgggaacgagaattatctggactacatgacctctatgaaacggttcaagaacgaaagcgatccggagggcgcgctctggtga

SEQ ID NO: 18606 - RNA, 9879 nt, synthetic construct
  misc_feature 1..9879: note = derived and/or modified CDS sequence (opt5) from DENV-1__GU131967__SS-prME
  source 1..9879: mol_type = other RNA
agcgtgaccatgctgctcatgctgcttcccacagctctggctttccacctcacgaccagaggcggggagcctcatatgatcgtctccaagcaggaacggggaaagtctctgctttttaagacaagcgctggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaagcagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaacatgcgatcaccgcctcatgtccgcggccattaaagacagcaaggctgtccatgccgatatgggctattggatcgaatctgagaaaaacgaaacctggaagctggcccgggcttccttcatcgaggttaagacatgtacctggcccaaaagccacacgctgtggtctaatggggtgctcgaatccgagatgattatcccgaagatttacggaggccctatcagccagcataactatagacccgggtacttcacccagacagccggaccttggcacctgggcaaacttgagctggactttgatctctgcgaagggaccacagtggtcgtggacgagcactgcggaaatcgcggcccctctctgcggaccacgacagttaccggcaagattatccatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgaccgggaccctggctgtgttccttctgctcgttatgggacaactgacatggaatgacctgatcagactttgcattatggtgggcgccaacgcctccgatcgcatgggcatggggacgacctatctggctctcatggccacatttaaaatgagacctatgttcgcggtcggactgctctttcggcgcctgacctctagagaggtgcttctgctcacaatcggcctgagcctggtggcttccgtcgaacttcccaactctctggaggaactcggggacggactggccatgggcattatgatgctcaagctgcttaccgagttccagccccaccagctgtggacgacactcctgagcctgacctttatcaaaaccacactttccctggattacgcctggaagaccacagctatggccctcagcatcgtttctctgttccctctctgtctgtccacgaccagccagaaaacaacctggcttccggtgctgctggggtcttttggatgcaagcccctcacaatgttcctgattaccgaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacgtctcacaacattctggtggaagtccaggacgatgggaccatgaagatcaaagacgaggagcgcgatgacacacttaccattctgctcaaggccacactgctcgctgtgagcggagtttaccccatgtccatccctgcgaccctgtttgtgtggtatttctggcagaaaaagaagcagagatctggcgtcctttgggatacacccagcccgcctgaagtggagcgggccgtcctggacgatggcatctaccgcattctgcaaagagggctcctgggacggtcccaggtgggcgttggggtgttccaggacggagtctttcatacgatgtggcacgtgacccgcggcgctgttcttatgtatcaggggaaaagactggaaccctcttgggccagcgtgaagaaagacctcatctcctacggaggcggctggcggttccaagggagctggaatacaggagaggaggtccaggtgattgccgtggaacctggcaagaaccccaaaaatgttcagaccaccccggggacatttaagacgcctgagggagaagtcggcgctatcgccctggatttcaagcccgggacctctggatcccctattgtgaacagagagggcaaaatcgtgggcctctacgggaatggagtcgtgacaaccagcggcacatatgtttctgcgattgctcaagccaaggcctcccaggaagggcccctgcccgagatcgaggacgaagtgtttaaaaagcgcaaccttaccatcatggatctgcaccctggaagcggcaaaacgcggagatacctgccggctattgtccgcgaggccatcaagcggaagctcagaacactgattcttgcgcccacccgcgtggttgcttccgaaatggccgaggccctgaaagggatgcctatccggtatcagaccacagctgtgaagtctgaacataccggcagagagattgtcgacctcatgtgccacgccacattcaccatgcgcctgctgagccccgtgcgggttcctaattacaacatgatcatcatggatgaggctcattttacggaccccgcctccattgcggccagaggatatatcagcacacgggtgggcatgggggaagctgccgctattttcatgaccgccacacctccgggatctgtcgaggcctttccccagtccaatgctgtgatccaagatgaggaacgcgacattcctgaaagaagctggaactctggctacgattggatcaccgacttccccgggaaaacggtgtggtttgtccctagcatcaagtccggaaatgatattgcgaactgtctccggaaaaacggcaagcgcgttatccagctttctagaaagaccttcgacacagagtatcagaaaaccaagaataacgactgggattacgtggtgacaaccgacattagcgagatgggggccaatttccgggctgatagagtcatcgacccccgccggtgcctgaaaccggtgattctgaaggatggccctgaaagagttatcctcgccggacccatgcccgtgacagtcgcctccgctgcccagcgccggggcagaattgggcgcaaccaaaataaagagggagaccagtacgtgtatatgggccagcctctgaacaatgatgaagaccacgcgcattggaccgaggctaagatgcttctggataacatcaatacgcccgaggggatcattcctgccctctttgaaccggagcgggaaaagtctgccgctatcgacggagagtacagactgcgcggcgaagccagaaaaacattcgttgagctgatgcggcgcggggatctccccgtgtggcttagctataaggtcgcgtccgagggctttcagtacagcgacagacggtggtgcttcgatggagaacgcaacaatcaagtgctggaggaaaacatggacgtcgagatttggaccaaagaaggcgagagaaagaaactgcggcctagatggctcgacgcccgcacctattctgatcccctggcccttcgggagtttaaggagttcgccgctgggagacgctccgtgagcggagacctgatcctcgagattggcaaactgcctcagcacctgacactccgggcccagaatgctcttgataacctggttatgctgcacaattccgaacaaggcgggaaggcctacagacatgcgatggaggaactccccgacaccatcgagacactgatgcttctggccctcatcgctgtgctgaccgggggcgtgacgctgtttttcctctctgggaagggacttggcaaaacaagcattgggctgctgtgtgtcaccgcctcctctgctctcctgtggatggccagcgttgagccgcactggatcgccgcttccattatccttgaatttttcctgatggtgctcctgattcctgagcccgatcggcaacgcacacctcaggacaaccagctggcgtatgtggtcatcggactcctttttatgatcctgaccgtggccgctaacgaaatgggcctgctcgagacgaccaagaaagatctggggattggacatgttgccgccgagaatcaccaacacgctacaatgcttgacgtggatctgagacccgccagcgcgtggaccctctacgccgtcgctacaaccgtgatcacgcctatgatgcggcatacaattgaaaacaccacagccaatatctctctgaccgctattgccaaccaggcggccatcctgatgggcctcgacaagggctggcccatttccaaaatggatatcggggtcccgcttctggctctgggatgctacagccaggtgaatcctctcaccctgacagccgctgttcttatgctggtggcccactatgctatcattggccccgggctccaggccaaggcgacgcgcgaggcccaaaagagaaccgctgccggaatcatgaaaaaccccacagtcgacggcattgtggctatcgatctggaccctgttgtgtacgacgccaagttcgaaaaacagctggggcagattatgctccttatcctgtgtacctctcagatcctgctcatgcggacaacctgggccctgtgcgagtccattacgcttgcgacaggaccgctgaccaccctctgggaaggcagccccggcaagttttggaatacaaccatcgctgtctctatggccaacattttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacacctacaagagaagcgggatcatggaggtggatcggtccgaagccaaagagggactgaagagaggcgaaacaaccaaacatgcggtgtctcgcgggacagccaaacttcggtggttcgttgagagaaatctggtcaagcctgagggaaaagtgattgacctcggctgtgggcgcggaggctggagctattactgcgctggcctgaagaaagtgaccgaagtcaaggggtatacgaaaggaggccccgggcacggagagcctatccccctggccacctacggctggaacctcgttaaacttcattccgggaaagatgtgtttttcatgcctccggaaaagtgtgacacactgctgtgcgatatcggagagtctagccccaatcctaccattgaagagggccggacactcagagtgctgaagatggtcgagccctggcttcgcggcaaccagttttgtatcaaaattctgaatccttacatgccctccgtggttgaagctctcgagcaaatgcagcggaagcacgggggaatgctggtgagaaacccgctgtctcgcaatagcacccacgaaatgtattgggtctcctgcggcacagggaacatcgtgagcgccgttaacatgacctctcggatgctcctgaatagattcacgatggcgcatcgcaaacctacatacgagcgggacgtggatcttggagccggcaccagacacgtcgctgtggagcccgaagtggccaacctggacattatcgggcagcgcattgagaatatcaagaacgaacataaatccacctggcactatgatgaggacaatccctacaagacatgggcttatcacggaagctacgaagtcaagccttctggctccgccagctctatggttaacggcgtggtgagactcctgacgaaaccctgggatgtcatccctatggtgacccaaattgctatgacagacaccacaccgtttgggcagcagcgggttttcaaggagaaagtggacacccgcacacccagagccaagcggggaaccacgcagatcatggaggtcaccgcgaaatggctttggggctttctgtccagaaataagaagcctcggatttgtacacgcgaagagttcaccagaaaagtgcggagcaacgccgctatcggggccgtttttgtggatgaaaatcaatggaactccgctaaggaggccgtcgaagacgagcgcttctgggatctcgtgcatagagagcgggaactgcacaaacagggaaagtgcgccacatgcgtttataatatgatgggcaaacgcgagaagaagctgggggaatttggcaaagcgaagggaagcagagctatttggtacatgtggctcggcgcccggttcctggagttcgaagcccttgggtttatgaacgaggaccattggttctctcgcgagaatagcctgtccggagtggaaggcgaggggctccacaaactgggatacatccttagagatatctctaagattcccggcgggaacatgtatgctgacgataccgccggctgggacacgcggatcacagaagatgacctgcagaatgaggctaaaattaccgagatcatggaacctgagcatgccctcctggcgacaagcatttttaagctgacctaccagaacaaagtcgtgcgcgtccaaagacccgccaagaacggaacggtgatggatgttatctcccggcgcgaccagagaggctctggacaggtgggaacctatggcctcaatacattcaccaacatggaagtccagctgatccggcaaatggagagcgaagggatttttcttccgtccgagctggagacacctaatctcgctgaaagagtgctggattggcttgagaagcacggagccgaacgcctgaaacggatggctatctctggcgacgactgtgtggttaagcccattgatgacagattcgccaccgcgctcacagccctgaacgatatggggaaagtgcgcaaggacatccctcagtgggagcccagcaaaggctggaatgattggcagcaggtccctttttgctcccaccatttccaccaactgattatgaaggacggacgggaaatcgtggttccctgtagaaaccaggatgagctcgtgggccgcgctcgggtcagccagggggccggatggtctctgagagagaccgcttgccttggcaagtcctacgcccaaatgtggcagctgatgtattttcatcgccgggacctcagactggctgccaatgcgatctgtagcgccgtgccggtcgattgggtgcctacgtctcgcacaacctggtccattcacgctcaccatcagtggatgaccacagaagacatgcttagcgtttggaaccgggtgtggatcgaggaaaatccctggatggaggataaaacccacgtctcctcttgggaagaggtgccctacctggggaagagagaggaccagtggtgcggaagcctcattggcctgacagcccgggccacgtgggctaccaacatccaagttgccattaatcaggtgagacgcctgatcgggaacgaaaattatctcgactacatgacatccatgaaacggttcaagaacgagagcgatcctgaaggcgcgctgtggtga

SEQ ID NO: 18607 - RNA, 9879 nt, synthetic construct
  misc_feature 1..9879: note = derived and/or modified CDS sequence (opt5) from DENV-1__GU131968__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccagaacgaaaagggggtgacacagaatggaagactcatcacggctaaccccattgtcaccgacaaagagaagcctgtgaatatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagatacagcgtgggacttcggctccatcgggggagtctttacctctgtgggcaaactggtgcatcaggtcttcgggacggcctacggagtgctttttagcggcgtttcctggaccatgaagatcgggattggcatcctgctcacatggctgggactgaacagccggtctacctcccttagcatgacatgtattgctgtgggcatggtcaccctctacctgggggtgatggttcaagccgattctggatgcgtgatcaactggaaaggcagagaactgaagtgtgggtccggaattttcgtcacaaatgaggtgcacacctggacggaacagtataagtttcaggctgacagccctaaacgcctctccgccgcgatcggcaaggcctgggaggagggggtttgcggcattcggtctgctacaagactggaaaacatcatgtggaaacagatcagcaatgagcttaaccatattctgctcgaaaatgatatgaagttcaccgtggtcgtgggagacgccaacggcatcctggctcaagggaaaaagatgattcgcccgcagcccatggagcacaaatactcctggaagtcttggggaaaggccaaaatcattggcgccgacatccagaataccacatttatcattgatgggcctgacacccccgaatgtcctgataaccagcgggcttggaatatctgggaggtggaggactatggattcggcatttttacgacaaacatctggctgaagcttagagatagctacacccaaatgtgcgaccaccgcctcatgtccgcggccattaaagatagcaaggctgtccatgccgacatgggctattggatcgaatctgagaaaaatgaaacatggaagctggagcgggcctccttcatcgaagttaagacctgtacatggcccaaaagccacaccctgtggtctaacggggtgctcgagtccgagatgattatcccgaagatttacggaggccctatcagccagcataattatagacccgggtacttcacgcagaccgctggaccttggcacctgggcaaacttgaactggattttgacctctgcgaggggacaaccgtggtcgtggatgaacactgcggaaaccgcggcccctctctgcggacaaccacggttacaggcaagattatccatgagtggtgttgcagaagctgtaccctgcctccccttcggttccgcggggaggacggatgctggtacggcatggaaatcagaccggtgaaagagaaggaagagaatctcgtccggtccatggtgagcgccgggtctggagaagttgattcctttagcctgggcattctgtgtgcgtccatcatgattgaggaggtgatgagatctcgctggagccggaagatgctcatgacagggaccctggctgtcttccttctgctcatcatgggacaactgacctggaacgacctgattagactttgcatcatggtgggcgccaacgcctccgaccgcatgggcatggggacaacgtatctggctctcatggccacctttaaaatgagacctatgttcgcggttggactgctctttcggcgcctgacatctagagaagtgcttctgctcaccattggcctgagcctggtcgcttccgtggagcttcccaattctctggaagagctcggggatggactggccatgggcatcatgatgctcaagctgcttacagaattccagccccaccagctgtggaccacgctcctgagcctgacatttatcaaaaccaccctttccctggactacgcctggaagacaaccgctatggccctcagcattgtgtctctgttccctctctgtctgtccacaacgagccagaaaaccacatggcttccggtcctgctggggtcttttggatgcaagcccctcaccatgttcctgatcacagagaacaagatttggggccggaaatcctggcctcttaatgagggcatcatggctattgggatcgttagcatcctgctctcttccctgctcaagaacgatgtgcccctggccggacctcttattgcgggcgggatgctgatcgcctgttatgtgattagcggatccagcgctgacctgtctctcgaaaaagccgctgaggtcagctgggaacaagaggccgaacattccggcacctctcacaatatcctggtggaggttcaggatgacgggacgatgaagattaaagatgaggaacgcgacgatacccttacaatcctgctcaaggccaccctgctcgctgtgagcggagtctaccccatgtccatccctgcgacactgtttgtgtggtatttctggcagaaaagaaagcagcggtctggcgttctttgggacacccccagcccgcctgaggtggaacgcgccgtcctggatgacggcatttacagaatcctgcaacgggggctcctgggacgctcccaggtgggcgtcggggtgttccaggatggagtttttcatacaatgtggcacgtgacgagaggcgctgtccttatgtatcaggggaagcggctggagccctcttgggccagcgtgaaaaaggacctcatttcctacggaggcggctggagattccaagggagctggaacaccggagaggaagttcaggtgatcgccgtcgagcctggcaaaaatcccaagaacgtgcagacaaccccggggacctttaaaacacctgaaggagaggtgggcgctattgccctggacttcaagcccgggacgtctggatcccctatcgttaatcgcgaaggcaagattgtcggcctctacgggaacggagtggtgaccacaagcggcacctatgtctctgcgatcgctcaagccaaagcctcccaggaggggcccctgcccgagatcgaagatgaggtgtttaagaaacggaatcttacaattatggacctgcaccctggaagcggcaagaccagacgctacctgccggctatcgttcgggaagccattaaaagaaagctccgcacgctgatccttgcgcccacacgggtggtcgcttccgagatggccgaagccctgaaggggatgcctattagatatcagaccaccgctgtgaaatctgagcatacaggccgcgagatcgttgatctcatgtgccacgccaccttcacaatgcggctgctgagccccgtgagagtccctaactacaatatgatcattatggacgaagctcattttaccgatcccgcctccatcgcggcccggggatatattagcacgcgcgtgggcatgggggaggctgccgctatcttcatgacagccacccctccgggatctgttgaagcctttccccagtccaacgctgtgattcaagacgaggaaagagatatccctgagcggagctggaattctggctacgactggatcacagatttccccgggaagaccgtctggtttgtgcctagcattaaatccggaaacgacatcgcgaactgtctccgcaagaatggcaaaagagtgattcagctttctcggaagacgttcgataccgagtatcagaagacaaaaaacaatgactgggactacgtcgttaccacagatatcagcgaaatgggggccaacttcagagctgaccgcgtgattgatccccggagatgcctgaagccggtgatcctgaaagacggccctgagcgcgtcattctcgccggacccatgcccgtgaccgttgcctccgctgcccagcggagaggccgcatcgggcggaatcaaaacaaggaaggagatcagtacgtgtatatgggccagcctctgaataacgacgaggatcacgcgcattggacagaggctaaaatgcttctggacaatatcaacacccccgaagggattatccctgccctctttgagccggaaagagagaagtctgccgctattgatggagaataccgcctgagaggcgaggcccggaagacgttcgtcgagctgatgcgcagaggggacctccccgtgtggcttagctataaagttgcgtccgaaggctttcagtacagcgatcggcgctggtgcttcgacggagagagaaataaccaagtgctggaagagaatatggatgtcgaaatctggacaaaggagggcgagcggaaaaagctgagacctcgctggctcgacgcccggacctattctgaccccctggctcttagagaatttaaagagttcgccgctgggcgccggtccgtgagcggagatctgattctcgaaatcggcaagctgcctcagcacctgaccctcagagcccagaacgctcttgacaatctggtcatgctgcacaactccgagcaggggggaaaagcctaccggcatgcgatggaagagctccccgatacaatcgagaccctgatgcttctggccctcattgctgtgctgacaggcggcgttacgctgtttttcctctctgggaagggacttggcaagaccagcatcgggctgctgtgtgtgacagcctcctctgctctcctgtggatggccagcgtggaaccgcactggattgccgcttccatcattcttgagtttttcctgatggtcctcctgatccctgaacccgaccgccaaagaacccctcaggataaccagctggcgtatgttgtgatcggactcctttttatgattctgacagtggccgctaatgagatgggcctgctcgagaccacgaaaaaggacctggggatcggacatgtcgccgccgaaaaccaccaacacgctaccatgcttgatgtggacctgcggcccgccagcgcgtggacactctacgccgttgctaccacagtgattacccctatgatgcgccatacgatcgagaatacaaccgccaacatttctctgacagctatcgccaatcaggcggccattctgatgggcctcgataaaggctggcccatctccaagatggacatcggggtcccgcttctggctctgggatgctacagccaggtgaaccctctcaccctgaccgccgctgtccttatgctggtggcccactatgctattatcggccccgggctccaggccaaagcgacaagagaagcccaaaagcggacggctgccggaattatgaagaatcccaccgttgatggcatcgtggctattgacctggatcctgtcgtgtacgacgccaaattcgagaagcagctggggcagatcatgctccttatcctgtgtacatctcagattctgctcatgcgcaccacatgggccctgtgcgaatccatcacccttgcgacgggaccgctgacaaccctctgggagggcagccccggcaaattttggaacaccacaattgctgtttctatggccaatatcttcagagggagctatctggctggagccggcctggccttctccctcatgaagtctcttgggggaggccggcgcgggaccggagctcaaggcgagacactgggcgaaaaatggaagagacagctgaaccagctcagcaagtccgagtttaatacgtacaaacggagcgggattatggaagtggacagatccgaggccaaggaaggactgaaacgcggcgagaccacaaagcatgcggtctctcgggggaccgccaaacttagatggttcgtggagcgcaacctggtgaagcctgaaggaaaggttatcgatctcggctgtgggcggggaggctggagctattactgcgctggcctgaaaaaggtcacagaggtgaaagggtataccaagggaggccccgggcacgaagagcctatccccatggccacgtacggatggaatctggtgaaactccattccggcaaggacgtctttttcatgcctccggaaaaatgtgatacccttctgtgcgacattggggagtctagccccaaccctacaatcgaggaaggaagaaccctgcgcgttctcaagatggtggagccctggctgcggggcaatcagttttgtattaagatccttaacccttacatgccctccgtggtcgaaacactggagcaaatgcagagaaaacacggcgggatgctcgtgcgcaatccgctgtctcggaacagcacccacgagatgtattgggtttcctgcggaacaggcaacattgtgagcgctgtcaatatgacctctagaatgctgctcaaccgcttcacgatggcccatcggaagcctacatttgaaagagatgtggacctgggggcgggaacccgccacgttgccgtggagcccgaagtcgctaatcttgatatcattggccagagaatcgagaacatcaaaaatgaacataagtccacctggcactacgacgaggataacccctataaaacatgggcctaccacgggagctatgaggtgaagccttctggatccgctagctctatggtgaatggcgtcgttcggctgctcacgaagccctgggacgtgattcctatggtgacccaaatcgccatgacagataccacaccgttcggccagcagcgcgtctttaaagaaaaggtggacaccagaacaccccgggctaaaagagggaccacgcagattatggaggttaccgccaagtggctgtggggattcctttcccggaacaaaaagcctcgcatctgtacaagagaagagtttacccggaaggtgcgcagcaatgcggccattggcgctgtcttcgtggacgaaaaccaatggaattccgccaaagaggctgttgaggatgaaagattttgggacctggtgcatcgggagcgcgaactccacaagcaggggaaatgcgccacatgcgtctacaacatgatgggaaagagagagaaaaagctgggcgaattcgggaaggccaaaggcagccgggcgatctggtatatgtggctgggagctcgcttcctcgagtttgaggccctgggcttcatgaatgaagatcattggttttctagagagaacagcctttccggggtggaaggagagggcctgcacaagctcgggtacatcctgcgggacatttctaaaatccccggaggcaatatgtacgccgatgacaccgctgggtgggatacgcgcattacagaggacgatcttcagaacgaagccaagatcaccgacattatggagcctgaacatgctctgctcgccacaagcatcttcaaactgacctatcagaacaaggttgtgagagtccaacggcccgcgaaaaatggcacggtgatggatgtcatctcccgcagagaccagcggggatctggccaggtggggacctacggactgaacacatttaccaatatggaggttcagctcattagacaaatggaaagcgagggcatcttcctgccgtccgagcttgaaacacctaacctggccgagcgcgtgctcgattggctggaaaagcacggggctgagcggcttaagagaatggccatttctggagacgactgtgtcgtgaaacccatcgatgaccgctttgctaccgccctgacagcgctcaatgatatgggcaaggtgcggaaagacattcctcagtgggaacccagcaaggggtggaacgattggcagcaggttcctttctgctcccaccattttcaccaactgatcatgaaagacggcagagagatcgtggtcccctgtcgcaatcaggatgagctggtgggacgggccagagttagccagggcgctgggtggtctctccgcgaaaccgcctgcctgggaaagtcctatgctcaaatgtggcagcttatgtacttccatcggagagacctgcgcctcgccgctaacgccatttgtagcgcggtgccggtcgattgggtgcctacgtctcggacaacctggtccatccacgcccaccatcagtggatgaccacagaggacatgctgagcgtctggaatagagtgtggattgaagagaacccctggatggaagataagacccacgtttcctcttgggaggaggtgccctatcttggcaaacgggaagaccagtggtgcgggagcctgatcggactcacagctagagccacgtgggccaccaatattcaagtcgctatcaaccaggtgcgccggctgattggcaatgagaactacctggactatatgacatccatgaagagatttaaaaatgaaagcgatcctgagggggccctctggtga

SEQ ID NO: 18608 - RNA, 9879 nt, synthetic construct
  misc_feature 1..9879: note = derived and/or modified CDS sequence (opt5) from DENV-1__GQ868506__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgcctttttcctggcgcatgccattgggacatctatcacccaaaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaagaataaacccacactggatatcgaactgctcaagaccgaggtcacaaaccctgccattctgcggaaactttgcatcgaagcgaagatttctaataccacgacagactcccgctgtccgacccagggagaggccaccctggttgaagagcaggatgctaactttgtgtgcagacggacattcgtggaccgcggctggggcaatgggtgtggactctttggcaaagggagcctgcttacctgcgccaagttcaagtgcgtcacaaaactggagggaaagatcgtgcagtacgaaaacctcaaatattctgttatcgtgacggtccacaccggcgatcaacatcaggtggggaatgagacaaccgaacacggaacaattgctaccatcacgccccaggcccctacctccgagattcagctgacagactacggcgccctgaccctcgactgtagccccagaacaggcctggattttaacgaaatggttcttctgaccatgaaggagaaatcttggctcgtgcataagcaatggttcctggaccttcctctgccctggacgtccggggctagcacatcccaggagacctggaatcggcaggatctcctggtcacatttaaaaccgcgcacgccaagaagcaagaagtggtcgtgctgggatctcaggagggcgctatgcacaccgccctcacaggggccacggaaatccagaccagcggaacaaccacaattttcgctggccatctgaaatgccgccttaagatggacaaactgaccctcaaggggacgtcctatgttatgtgtacaggcagcttcaaactggagaaggaagtggccgagacccagcacggaaccgtcctggtgcaagttaagtacgagggcacagatgcgccgtgcaaaatccctttttctacccaggacgaaaagggggtgacacagaacggaagacttatcacggctaatcccattgtcaccgataaagagaagcctgtgaacatcgaaacagagccccccttcggcgagtcctatattgtggttggggccggagaaaaagccctcaagctgagctggtttaagaaaggctctagcatcgggaagatgttcgaggctaccgcccggggcgctagacgcatggccattctgggagacacagcgtgggattttggctccatcgggggagtcttcacctctgtgggcaaactcgtgcatcaggtctttgggacggcctacggagtgctgttcagcggcgtttcctggaccatgaagatcgggattggcatccttctgacatggctcggactgaatagccggtctacctccctgagcatgacatgtattgctgtgggcatggtcaccctttacctcggggtgatggttcaagccgactctggatgcgtgatcaactggaaaggcagagaactgaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagactcgaaaatatcatgtggaaacagatcagcaacgagctgaatcatattcttctggaaaacgacatgaagtttaccgtggtcgtgggagacgccaatggcatcctcgctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacaatcagcgggcttggaacatctgggaggtggaggattatggatttggcattttcacgacaaatatctggctgaagctgagagacagctacacccaaatgtgcgatcaccgccttatgtccgcggccattaaagacagcaaggctgtccatgccgatatgggctattggatcgaatctgagaaaaacgaaacatggaagctcgcccgggcttccttcatcgaggttaagacctgtacatggcccaaaagccacaccctgtggtctaatggggtgctggaatccgagatgattatcccgaagatttacggaggccctatcagccagcataactatagacccgggtactttacgcagaccgccggaccttggcacctcggcaaactggagcttgacttcgatctgtgcgaagggacaaccgtggtcgtggacgagcactgcggaaatcgcggcccctctctccggacaaccacggttacaggcaagattatccatgaatggtgttgcagaagctgtaccctgcctcccctgcggtttcgcggggaggatggatgctggtacggcatggagatcagaccggtgaaagaaaaggaggaaaaccttgtccggtccatggtgagcgcggggtctggagaggttgactccttcagcctcggcattctgtgtgtgtccatcatgattgaagaggtcatgagatctcgctggagccggaagatgctgatgacagggaccctcgctgtgtttctgcttctggttatgggacaactcacctggaatgacctgatcagactgtgcattatggtgggcgccaacgcctccgatcgcatgggcatggggacaacgtatcttgctctgatggccaccttcaaaatgagacctatgtttgcggtcggactcctgttccggcgcctcacatctagagaggtgctgcttctgaccatcggcctcagcctggtggcttccgtcgaactgcccaactctcttgaggaactgggggacggactcgccatgggcattatgatgctgaagctcctgacagagtttcagccccaccagctttggaccacgctgctcagcctgacattcatcaaaaccaccctgtcccttgattacgcctggaagacaaccgctatggccctgagcatcgtttctctctttcctctgtgtctctccacaacgagccagaaaaccacatggctgccggtgcttctggggtctttcggatgcaagcccctgaccatgtttctcattacagaaaataagatctggggccggaaatcctggcctctgaacgagggcattatggctatcgggattgtgagcatccttctgtcttccctcctgaagaatgacgtccccctcgccggacctctgatcgcgggcgggatgcttattgcctgttatgtgatcagcggatccagcgctgatctgtctctggagaaagccgctgaagttagctgggagcaagaagccgagcattccggcacctctcacaacattctcgtggaagtccaggacgatgggacgatgaagatcaaagacgaggagcgcgatgacaccctgacaattcttctgaaggccaccctcctggctgtgagcggagtttaccccatgtccatccctgcgacactcttcgtgtggtatttctggcagaaaaagaagcagagatctggcgtcctgtgggatacccccagcccgcctgaagtggagcgggccgtccttgacgatggcatctaccgcattctgcaaagagggctgctcggacggtcccaggtgggcgttggggtgtttcaggacggagtcttccatacaatgtggcacgtgacgcgcggcgctgttctgatgtatcaggggaaaagacttgaaccctcttgggccagcgtgaagaaagacctgatctcctacggaggcggctggcggtttcaagggagctggaataccggagaggaggtccaggtgattgccgtggaacctggcaagaaccccaaaaatgttcagacaaccccggggaccttcaagacacctgagggagaagtcggcgctatcgccctcgattttaagcccgggacgtctggatcccctattgtgaacagagagggcaaaatcgtgggcctgtacgggaatggagtcgtgaccacaagcggcacctatgtttctgcgattgctcaagccaaggcctcccaggaagggcccctccccgagatcgaggacgaagtgttcaaaaagcgcaacctgacaatcatggatcttcaccctggaagcggcaaaacccggagatacctgccggctattgtccgcgaggccatcaagcggaagctgagaacgctcattctggcgcccacacgcgtggttgcttccgaaatggccgaggcccttaaagggatgcctatccggtatcagaccaccgctgtgaagtctgaacatacaggcagagagattgtcgacctgatgtgccacgccacctttacaatgcgcctcctgagccccggacgggtgcctaattacaacatgatcatcatggatgaggctcatttcaccgaccccgcctccattgcggccagaggctatatcagcacgcgggttgggatgggagaagctgccgctatttttatgacagccacccctccgggctctgtggaggccttcccccagtccaatgctgtcatccaagatgaagagcgcgacattcctgaaagaagctggaactctgggtacgattggatcacagactttcccggaaaaaccgtgtggttcgtgcctagcatcaagtccggcaatgatattgcgaactgtctgcggaaaaacgggaagcgcgtcatccagctctctagaaagacgttcgacaccgagtatcagaaaacaaagaataacgactgggattacgttgtgaccacagacattagcgagatgggcgccaattttcgggctgatagagtgatcgacccccgccggtgccttaaaccggtcattctgaaggatggacctgaaagagtgatcctggccggccccatgcccgttaccgtggcctccgctgcccagcgccgggggagaattggacgcaaccaaaataaagagggcgaccagtacgtctatatggggcagcctctcaacaatgatgaagaccacgcgcattggacagaggctaagatgctgcttgataacatcaatacccccgagggaatcattcctgccctgttcgaaccggagcgggaaaagtctgccgctatcgacggcgagtacagactccgcggggaagccagaaaaacgtttgtggagctgatgcggcgcggcgatctgcccgtttggctcagctataaggtggcgtccgagggattccagtacagcgacagacggtggtgctttgatggcgaacgcaacaatcaagtccttgaggaaaacatggacgtggagatttggacaaaagaaggggagagaaagaaactgcggcctagatggctggacgcccgcacctattctgatcccctcgctctgcgggagttcaaggaatttgccgctggaagacgctccgtcagcggcgaccttatcctggagattgggaaactccctcagcacctgaccctgcgggcccagaatgctctcgataaccttgtgatgctgcacaattccgaacagggaggcaaggcctacagacatgcgatggaggaactgcccgacacaatcgagaccctcatgctgcttgccctgatcgctgttctcacaggcggggtgacgctgttctttctgtctggaaagggcctcgggaaaaccagcattggacttctgtgtgtgacagcctcctctgctctgctctggatggccagcgtcgagccgcactggatcgccgcttccattatcctggaattctttcttatggttctgctcattcctgagcccgatcggcaacgcacccctcaggacaaccagctggcgtatgtggtgatcggcctgctcttcatgatccttacagtcgccgctaacgaaatggggctgctggagaccacgaagaaagatctcggaattggccatgtggccgccgagaatcaccaacacgctaccatgctggacgttgatcttagacccgccagcgcgtggacactgtacgccgtggctaccacagtcatcacccctatgatgcggcatacgattgaaaacacaaccgccaatatctctctcacagctattgccaaccaggcggccatcctgatgggcctggacaaggggtggcccatttccaaaatggatatcggagtgccgctccttgctctgggctgctacagccaggtcaatcctctgaccctcaccgccgctgtgctgatgcttgttgcccactatgctatcattgggcccggactgcaggccaaggcgacacgcgaggcccaaaagagaacggctgccggcatcatgaaaaaccccaccgtggacgggattgtcgctatcgatctcgaccctgtggtttacgacgccaagtttgaaaaacagctgggacagattatgctgctcatcctttgtacatctcagatcctgctgatgcggaccacatgggccctctgcgagtccattaccctggcgacgggcccgcttacaaccctgtgggaaggcagccccgggaagttctggaataccacaatcgctgtgtctatggccaacattttccgcggaagctatctcgctggcgccgggctggccttttccctgatgaaatctctcggaggcgggagacggggaaccggcgctcaaggcgagacacttggggagaagtggaagcgccagctgaatcagctgagcaaatccgaattcaacacgtacaagagaagcggaatcatggaggtcgatcggtccgaagccaaagagggcctcaagagaggggaaaccacaaaacatgcggtgtctcgcggaaccgccaagctgcggtggtttgtggagagaaatcttgttaagcctgagggcaaagtcattgacctggggtgtggacgcggcggctggagctattactgcgctgggctcaagaaagtgacagaagtgaagggatataccaaaggcgggcccggacacgaggaacctatccccatggccacgtacggctggaacctggtcaagctgcattccgggaaagatgttttctttatgcctccggagaagtgtgacaccctcctttgcgatatcggagaatctagccccaatcctacaattgaggagggccggaccctgagagtgctgaagatggtggaaccctggctccgcggcaaccagttctgtatcaaaattctgaatccttacatgccctccgtcgtggaggctcttgaacaaatgcagcggaagcacgggggaatgctggttagaaacccgctctctcgcaatagcacacacgagatgtattgggtgtcctgcggcaccgggaacatcgtcagcgccgtgaacatgacatctcggatgctgctgaatagatttaccatggcgcatcgcaaacctacgtacgagcgggacgttgatctcggagccggcacaagacacgtggctgtcgaacccgaggtggccaacctggacattatcgggcagcgcattgaaaatatcaagaacgagcataaatccacctggcactatgatgaagacaatccctacaagacctgggcttatcacggaagctacgaggtgaagccttctggctccgccagctctatggtcaacggcgttgtgagacttctgacaaaaccctgggatgtgatccctatggtcacgcaaattgctatgaccgacacaaccccgttcgggcagcagcgggtgtttaaggagaaagttgacacacgcacccccagagccaagcggggaacaacccagatcatggaagtgacggcgaaatggctctggggcttcctgtccagaaataagaagcctcggatttgtacccgcgaggaatttacaagaaaagtccggagcaacgccgctatcggggccgtgttcgttgatgagaatcaatggaactccgctaaggaagccgtggaggacgagcgcttttgggatcttgtccatagagaacgggagctgcacaaacagggaaagtgcgccacctgcgtgtataatatgatgggcaaacgcgaaaagaagctcggggagttcggcaaagcgaagggaagcagagctatttggtacatgtggctgggcgcccggttcctggaatttgaggccctcgggttcatgaacgaggaccattggttttctcgcgaaaatagcctgtccggagttgagggcgaagggcttcacaaactgggatacatcctcagagatatctctaagattcccggcgggaacatgtatgctgacgatacagccggctgggacacccggatcacggaggatgacctgcagaatgaggctaaaattacagaaatcatggagcctgaacatgcccttctggcgaccagcattttcaagctcacataccagaacaaagtggtccgcgtgcaaagacccgccaagaacggaaccgtcatggatgtgatctcccggcgcgaccagagaggctctgggcaggttggaacgtatggcctgaatacctttacaaacatggaggtgcagctgatccggcaaatggaaagcgaggggattttcctcccgtccgagctggaaacccctaatcttgctgagagagtcctggattggctcgaaaagcacggagccgagcgcctgaaacggatggctatctctggcgacgactgtgtggtgaagcccattgatgacagatttgccacagcgcttaccgccctgaacgatatggggaaagttcgcaaggacatccctcagtgggaacccagcaaaggctggaatgattggcagcaggtgcctttctgctcccaccattttcaccaactcattatgaaggacggacgggagatcgtcgtgccctgtagaaaccaggatgagctggttggccgcgctcgggtgagccagggggccggatggtctctgagagaaacagcttgcctcggcaagtcctacgcccaaatgtggcagctgatgtatttccatcgccgggaccttagactggctgccaatgcgatctgtagcgccgtcccggtggattgggtccctacctctcgcacgacatggtccattcacgctcaccatcagtggatgaccaccgaggacatgctcagcgtgtggaaccgggtttggatcgaagagaatccctggatggaagataaaacacacgtgtcctcttgggaggaggtcccctacctggggaagagagaagaccagtggtgcggaagccttattggcctgaccgcccgggccacatgggctacgaacatccaagtggccattaatcaggttagacgcctcatcgggaacgagaattatctggactacatgacctccatgaaacggtttaagaacgaaagcgatcctgagggcgcgctgtggtga

SEQ ID NO: 18609 - RNA, 9879 nt, synthetic construct
  misc_feature 1..9879: note = derived and/or modified CDS sequence (opt5) from DENV-1__GQ868507__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggatcaccctcctgagcctgacgtttatcaaaacaaccctttccctggattacgcttggaagaccacagccatggctctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggccattgggatcgtgagcatcctgctctcttccctgctcaagaatgacgtgcccctggcgggacctcttattgccggcgggatgctgatcgcttgttatgtcattagcggatccagcgccgatctgtctctcgagaaagctgccgaagtgagctgggagcaagaagccgagcattccggcacatctcacaacatcctggttgaagtgcaggacgatgggaccatgaagattaaagacgaggagcgcgatgacacgcttaccatcctgctcaaggctacactgctcgcggtcagcggagtgtaccccatgtccatccctgccaccctgtttgtttggtatttctggcagaaaaagaagcagagatctggcgtgctttgggatacacccagcccgcctgaagtcgagcgggctgtgctggacgatggcatttaccgcatcctgcaaagagggctcctgggacggtcccaggtcggcgtgggggttttccaggacggagtgtttcataccatgtggcacgtcacacgcggcgccgtgcttatgtatcaggggaaaagactggaaccctcttgggccagcgttaagaaagacctcatttcctacggaggcggctggcggttccaagggagctggaatacgggagaggaggtgcaggtcatcgctgtggaacctggcaagaaccccaaaaatgtgcagaccatgccggggacatttaagacccctgagggagaagttggcgccattgcgctggatttcaagcccgggacctctggatcccctatcgtcaacagagagggcaaaattgtgggcctctacgggaatggagtggtcacaacgagcggcacctatgtgtctgctatcgcccaagccaaggcttcccaggaagggcccctgcccgagatcgaggacgaagtttttaaaaagcgcaaccttacaattatggatctgcaccctggaagcggcaaaacccggagatacctgccggccatggtgcgcgaggcgatcaagcggaagctcagaacactgattcttgctcccacccgcgtcgtggcctccgaaatggccgaggctctgaaagggatgcctatccggtatcagacgacagccgttaagtctgaacataccggcagagagattgtggacctcatgtgccacgctaccttcacaatgcgcctgctgagccccgtccgggtgcctaattacaacatgatcatcatggatgaggcccattttaccgaccccgcgtccattgccgctagaggatatatcagcacacgggttggcatgggggaagccgctgccattttcatgaccgccacgcctccgggatctgtggaggcttttccccagtccaatgcggtcatccaagatgaagaacgcgacattcctgaaagaagctggaactctggctacgattggatcacagacttccccgggaaaaccgtgtggtttgtgcctagcatcaagtccggaaatgatattgccaactgtctccggaaaaacggcaagcgcgtcatccagctttctagaaagacattcgacaccgagtatcagaaaacgaagaataacgactgggattacgttgtgaccacagacattagcgagatgggggctaatttccgggccgatagagtgatcgacccccgccggtgcctgaaaccggtcattctgaaggatggccctgaaagagtgatcctcgccggacccatgcccgttaccgtggcttccgccgcgcagcgccggggcagaattgggcgcaaccaaaataaagagggagaccagtacgtctatatgggccagcctctgaacaatgatgaagaccacgctcattggacagaggccaagatgcttctggataacatcaatacccccgaggggatcattcctgccctctttgaaccggagcgggaaaagtctgctgccatcgacggagagtacagactgcgcggcgaagcgagaaaaacattcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgctcgcacgtattctgatcccctggcccttcgggagtttaaggagttcgctgccgggagacgctccgtcagcggagacctgatcctcgagattggcaaactgcctcagcacctgacactccgggctcagaatgcccttgataacctggtgatgctgcacaattccgaacaagggggaaaggcgtacagacatgccatggaggaactccccgacaccatcgagaccctgatgcttctggctctcatcgccgttctgacaggcggcgtgaccctgtttttcctctctgggaagggacttggcaaaacaagcattgggctgctgtgtgtgacggcttcctctgccctcctgtggatggccagcgtcgagccgcactggatcgctgcgtccattatccttgaatttttcctgatggttctcctgattcctgagcccgatcggcaacgcacccctcaggacaaccagctggcctatgtggtgatcggactcctttttatgatcctgacagtcgctgccaacgaaatgggcctgctcgagaccacaaagaaagatctggggattggacatgtggccgctgagaatcaccaacacgccaccatgcttgacgttgatctgagacccgcgagcgcctggacgctctacgctgtggccaccacagtcatcacccctatgatgcggcatacaattgaaaacaccacggctaatatctctctgacagccattgcgaaccaggccgctatcctgatgggcctcgacaagggctggcccatttccaaaatggatatcggggtgccgcttctggccctgggatgctacagccaggtcaatcctctcaccctgacagctgccgtgcttatgctggttgctcactatgccatcattggccccgggctccaggcgaaggccacccgcgaggctcaaaagagaaccgccgctggaatcatgaaaaaccccacagtggacggcattgtcgccatcgatctggaccctgtggtttacgacgccaagttcgaaaaacagctggggcagattatgctccttatcctgtgtacgtctcagatcctgctcatgcggaccacatgggcgctgtgcgagtccattacccttgctacaggaccgctgaccacgctctgggaaggcagccccggcaagttttggaatacaaccatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacctacaagagaagcgggatcatggaggtcgatcggtccgaagcgaaagagggactgaagagaggcgaaacaacgaaacatgccgtgtctcgcgggaccgctaaacttcggtggttcgtggagagaaatctggttaagcctgagggaaaagtcattgacctcggctgtgggcgcggaggctggagctattactgcgccggcctgaagaaagtgacagaagtgaaggggtataccaaaggaggccccgggcacgaggaacctatccccatggctacatacggatggaacctggtcaagctcccttccggcaaagatgtgtttttcatgccgcccgagaagtgtgacacccttctgtgcgatatcggggaatctagccctaatcccacgattgaggagggacggaccctgagagttctcaagatggtggaaccttggctgcgcggcaaccagttttgtatcaaaattcttaatccctacatgccgtccgtcgtggagacactggaacaaatgcagcggaagcatggcgggatgctcgttagaaaccctctgtctcgcaatagcacccacgagatgtattgggtgtcctgcggaacaggcaacatcgtcagcgccgtgaacatgacctctcggatgctgctcaatagattcacaatggcgcaccgcaaacccacctacgagcgggacgttgatctgggggccggaacgagacatgtggctgtcgaacccgaggtggccaaccttgacattatcggccagcgcattgaaaatatcaagaacgagcacaaatccacatggcattatgatgaagacaatccttacaagacctgggcttatcacgggagctacgaggtgaagccctctggatccgccagctctatggtcaacggcgttgtgagactgctcaccaaaccttgggatgtgatcccgatggtcacacaaattgctatgacggacaccacaccctttggccagcagcgggtgttcaaggagaaagttgacacccgcacacctagagccaagcgggggaccacacagatcatggaagtgaccgcgaaatggctgtggggatttctttccagaaataagaagccccggatttgtacgcgcgaggagttcaccagaaaagtccggagcaacgccgctatcggcgccgtgtttgttgatgagaatcaatggaactccgctaaggaagccgtggaggacgagcgcttctgggatctggtccacagagaacgggagctccataaacaggggaagtgcgccacatgcgtgtataatatgatgggaaaacgcgaaaagaagctgggcgagtttgggaaagcgaagggcagcagagctatttggtacatgtggctgggagcccggttcctcgagttcgaggccctgggctttatgaacgaggaccactggttctctcgcgaaaatagcctttccggggttgagggagaaggcctgcataaactcgggtacatcctgagagatatctctaagattcctggaggcaacatgtatgctgacgataccgccgggtgggacacacggatcaccgaggatgaccttcagaatgaggctaaaattacggaaatcatggagcccgaacacgccctgctcgcgacaagcatttttaagctgacctaccagaacaaagtggtccgcgtgcaaagaccggccaagaacggcacagtcatggatgtgatctcccggcgcgaccagagaggatctggccaggttgggacctatggactgaatacgttcaccaacatggaggtgcagctcatccggcaaatggaaagcgagggcatttttctgccttccgagcttgaaacacccaatctggctgagagagtcctcgattggctggaaaagcatggggccgagcgccttaaacggatggctatctctggagacgactgtgtggtgaagcctattgatgacagattcgccaccgcgctgacagccctcaacgatatgggcaaagttcgcaaggacatcccccagtgggaacctagcaaagggtggaatgattggcaacaggtgcccttttgctcccaccacttccatcaactgattatgaaggacggccgggagatcgtcgtgccgtgtagaaaccaggatgagctggttggacgcgctcgggtgagccagggcgccgggtggtctctcagagaaaccgcttgcctgggaaagtcctacgcccaaatgtggcagcttatgtattttcaccgccgggacctgagactcgctgccaatgcgatctgtagcgccgtccctgtggattgggtccccacatctcgcaccacgtggtccattcatgctcaccaccagtggatgacaaccgaggacatgctgagcgtgtggaaccgggtttggatcgaagagaatccctggatggaagataaaacccatgtgtcctcttgggaggaggtcccttaccttggcaagagagaagaccagtggtgcgggagcctgattggactcacagcccgggccacctgggctacaaacatccaagtggccattaatcaggttagacgcctgatcggcaacgagaattatctggactacatgacgtccatgaaacggttcaagaacgaaagcgatccggagggggcgctctggtga

SEQ ID NO: 18610 - RNA, 9879 nt, synthetic construct
  misc_feature 1..9879: note = derived and/or modified CDS sequence (opt5) from DENV-1__GQ868508__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggatcaccctcctgagcctgacgtttatcaaaacaaccctttccctggattacgcttggaagaccacagccatggctctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggccattgggatcgtgagcatcctgctctcttccctgctcaagaatgacgtgcccctggcgggacctcttattgccggcgggatgctgatcgcttgttatgtcattagcggatccagcgccgatctgtctctcgagaaagctgccgaagtgagctgggagcaagaagccgagcattccggcacatctcacaacatcctggttgaagtgcaggacgatgggaccatgaagattaaagacgaggagcgcgatgacacgcttaccatcctgctcaaggctacactgctcgcggtcagcggagtgtaccccatgtccatccctgccaccctgtttgtttggtatttctggcagaaaaagaagcagagatctggcgtgctttgggatacacccagcccgcctgaagtcgagcgggctgtgctggacgatggcatttaccgcatcctgcaaagagggctcctgggacggtcccaggtcggcgtgggggttttccaggacggagtgtttcataccatgtggcacgtcacacgcggcgccgtgcttatgtatcaggggaaaagactggaaccctcttgggccagcgttaagaaagacctcatttcctacggaggcggctggcggttccaagggagctggaatacgggagaggaggtgcaggtcatcgctgtggaacctggcaagaaccccaaaaatgtgcagaccatgccggggacatttaagacccctgagggagaagttggcgccattgcgctggatttcaagcccgggacctctggatcccctatcgtcaacagagagggcaaaattgtgggcctctacgggaatggagtggtcacaacgagcggcacctatgtgtctgctatcgcccaagccaaggcttcccaggaagggcccctgcccgagatcgaggacgaagtttttaaaaagcgcaaccttacaattatggatctgcaccctggaagcggcaaaacccggagatacctgccggccatggtgcgcgaggcgatcaagcggaagctcagaacactgattcttgctcccacccgcgtcgtggcctccgaaatggccgaggctctgaaagggatgcctatccggtatcagacgacagccgttaagtctgaacataccggcagagagattgtggacctcatgtgccacgctaccttcacaatgcgcctgctgagccccgtccgggtgcctaattacaacatgatcatcatggatgaggcccattttaccgaccccgcgtccattgccgctagaggatatatcagcacacgggttggcatgggggaagccgctgccattttcatgaccgccacgcctccgggatctgtggaggcttttccccagtccaatgcggtcatccaagatgaagaacgcgacattcctgaaagaagctggaactctggctacgattggatcacagacttccccgggaaaaccgtgtggtttgtgcctagcatcaagtccggaaatgatattgccaactgtctccggaaaaacggcaagcgcgtcatccagctttctagaaagacattcgacaccgagtatcagaaaacgaagaataacgactgggattacgttgtgaccacagacattagcgagatgggggctaatttccgggccgatagagtgatcgacccccgccggtgcctgaaaccggtcattctgaaggatggccctgaaagagtgatcctcgccggacccatgcccgttaccgtggcttccgccgcgcagcgccggggcagaattgggcgcaaccaaaataaagagggagaccagtacgtctatatgggccagcctctgaacaatgatgaagaccacgctcattggacagaggccaagatgcttctggataacatcaatacccccgaggggatcattcctgccctctttgaaccggagcgggaaaagtctgctgccatcgacggagagtacagactgcgcggcgaagcgagaaaaacattcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgctcgcacgtattctgatcccctggcccttcgggagtttaaggagttcgctgccgggagacgctccgtcagcggagacctgatcctcgagattggcaaactgcctcagcacctgacactccgggctcagaatgcccttgataacctggtgatgctgcacaattccgaacaagggggaaaggcgtacagacatgccatggaggaactccccgacaccatcgagaccctgatgcttctggctctcatcgccgttctgacaggcggcgtgaccctgtttttcctctctgggaagggacttggcaaaacaagcattgggctgctgtgtgtgacggcttcctctgccctcctgtggatggccagcgtcgagccgcactggatcgctgcgtccattatccttgaatttttcctgatggttctcctgattcctgagcccgatcggcaacgcacccctcaggacaaccagctggcctatgtggtgatcggactcctttttatgatcctgacagtcgctgccaacgaaatgggcctgctcgagaccacaaagaaagatctggggattggacatgtggccgctgagaatcaccaacacgccaccatgcttgacgttgatctgagacccgcgagcgcctggacgctctacgctgtggccaccacagtcatcacccctatgatgcggcatacaattgaaaacaccacggctaatatctctctgacagccattgcgaaccaggccgctatcctgatgggcctcgacaagggctggcccatttccaaaatggatatcggggtgccgcttctggccctgggatgctacagccaggtcaatcctctcaccctgacagctgccgtgcttatgctggttgctcactatgccatcattggccccgggctccaggcgaaggccacccgcgaggctcaaaagagaaccgccgctggaatcatgaaaaaccccacagtggacggcattgtcgccatcgatctggaccctgtggtttacgacgccaagttcgaaaaacagctggggcagattatgctccttatcctgtgtacgtctcagatcctgctcatgcggaccacatgggcgctgtgcgagtccattacccttgctacaggaccgctgaccacgctctgggaaggcagccccggcaagttttggaatacaaccatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacctacaagagaagcgggatcatggaggtcgatcggtccgaagcgaaagagggactgaagagaggcgaaacaacgaaacatgccgtgtctcgcgggaccgctaaacttcggtggttcgtggagagaaatctggttaagcctgagggaaaagtcattgacctcggctgtgggcgcggaggctggagctattactgcgccggcctgaagaaagtgacagaagtgaaggggtataccaaaggaggccccgggcacgaggaacctatccccatggctacatacggatggaacctggtcaagctccattccggcaaagatgtgtttttcatgcctccggagaagtgtgacacccttctgtgcgatatcggggaatctagccccaatcctacgattgaggagggacggaccctgagagttctcaagatggtggaaccctggctgcgcggcaaccagttttgtatcaaaattcttaatccttacatgccctccgtcgtggagacactggaacaaatgcagcggaagcacggcgggatgctcgttagaaacccgctgtctcgcaatagcacccacgagatgtattgggtgtcctgcggaacaggcaacatcgtcagcgccgtgaacatgacctctcggatgctgctcaatagattcacaatggcgcatcgcaaacctacctacgagcgggacgttgatctgggggccggaacgagacacgtggctgtcgaacccgaggtggccaaccttgacattatcggccagcgcattgaaaatatcaagaacgagcataaatccacatggcactatgatgaagacaatccctacaagacctgggcttatcacgggagctacgaggtgaagccttctggatccgccagctctatggtcaacggcgttgtgagactgctcaccaaaccctgggatgtgatccctatggtcacacaaattgctatgacggacaccacaccgtttggccagcagcgggtgttcaaggagaaagttgacacccgcacacccagagccaagcgggggaccacacagatcatggaagtgaccgcgaaatggctgtggggatttctttccagaaataagaagcctcggatttgtacgcgcgaggagttcaccagaaaagtccggagcaacgccgctatcggcgccgtgtttgttgatgagaatcaatggaactccgctaaggaagccgtggaggacgagcgcttctgggatctggtccatagagaacgggagctccacaaacaggggaagtgcgccacatgcgtgtataatatgatgggaaaacgcgaaaagaagctgggcgagtttgggaaagcgaagggcagcagagctatttggtacatgtggctgggagcccggttcctcgagttcgaggccctgggctttatgaacgaggaccattggttctctcgcgaaaatagcctttccggggttgagggagaaggcctgcacaaactcgggtacatcctgagagatatctctaagattcccggaggcaacatgtatgctgacgataccgccgggtgggacacacggatcaccgaggatgaccttcagaatgaggctaaaattacggaaatcatggagcctgaacatgccctgctcgcgacaagcatttttaagctgacctaccagaacaaagtggtccgcgtgcaaagacccgccaagaacggcacagtcatggatgtgatctcccggcgcgaccagagaggatctggccaggttgggacctatggactgaatacgttcaccaacatggaggtgcagctcatccggcaaatggaaagcgagggcatttttctgccgtccgagcttgaaacacctaatctggctgagagagtcctcgattggctggaaaagcacggggccgagcgccttaaacggatggctatctctggagacgactgtgtggtgaagcccattgatgacagattcgccaccgcgctgacagccctcaacgatatgggcaaagttcgcaaggacatccctcagtgggaacccagcaaagggtggaatgattggcaacaggtgcctttttgctcccaccatttccaccaactgattatgaaggacggccgggagatcgtcgtgccctgtagaaaccaggatgagctggttggacgcgctcgggtgagccagggcgccgggtggtctctcagagaaaccgcttgcctgggaaagtcctacgcccaaatgtggcagcttatgtattttcatcgccgggacctgagactcgctgccaatgcgatctgtagcgccgtcccggtggattgggtccctacatctcgcaccacgtggtccattcacgctcaccatcagtggatgacaaccgaggacatgctgagcgtgtggaaccgggtttggatcgaagagaatccctggatggaagataaaacccacgtgtcctcttgggaggaggtcccctaccttggcaagagagaagaccagtggtgcgggagcctgattggactcacagcccgggccacctgggctacaaacatccaagtggccattaatcaggttagacgcctgatcggcaacgagaattatctggactacatgacgtccatgaaacggttcaagaacgaaagcgatcctgagggggcgctctggtga

SEQ ID NO: 18611 - RNA, 9879 nt, synthetic construct
  misc_feature 1..9879: note = derived and/or modified CDS sequence (opt5) from DENV-1__GQ868509__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagatgagcggaaccacaaccatttttgctggccatcttaaatgccgcctgaagatggacaaactcacactgaaggggacctcctatgttatgtgtacgggcagcttcaaactggagaaggaagtggccgagacacagcacggaaccgtccttgtgcaagttaagtacgagggcaccgatgcgccgtgcaaaatccctttctctacacaggacgaaaagggggtgacccagaacggaagactcatcacagctaatcccattgtcacggataaagagaagcctgtgaacatcgaaaccgagcccccctttggcgagtcctatattgtggttggggccggagaaaaagccctgaagctgagctggttcaagaaaggctctagcatcgggaagatgtttgaggctacagcccggggcgctagacgcatggccattctcggagacaccgcgtgggatttcggctccatcgggggagtctttacatctgtgggcaaactggtgcatcaggtcttcgggaccgcctacggagtgctttttagcggcgtttcctggacgatgaagatcgggattggcatcctgctcacctggctgggactgaatagccggtctacatcccttagcatgacctgtattgctgtgggcatggtcacactctacctgggggtgatggttcaagccgactctggatgcgtgatcaactggaaaggcagagaactgaagtgtgggtccggaattttcgtcaccaacgaggtgcacacatggaccgaacagtataagtttcaggctgatagccctaaacgcctctccgccgcgatcggcaaggcctgggaggagggggtttgcggcattcggtctgtgacgagactggaaaatatcatgtggaaacagatcagcaacgagcttaatcatattctgctcgaaaacgacatgaagttcacagtcgtggtgggagacgctaatggcatcctggcccaagggaaaaagatgattcgcccgcagcccatggagcacaaatactcctggaagtcttggggaaaggctaaaatcattggcgccgatatccagaacaccacctttatcattgacgggcctgatacacccgaatgtcctgacaatcagcgggcctggaacatctgggaggtcgaggattatggattcggcatttttaccacgaatatctggctgaagcttagagacagctacacacaaatgtgcgatcaccgcctcatgtccgctgcgattaaagacagcaaggccgttcatgctgatatgggctattggatcgaatctgagaaaaacgaaacctggaagctggcccgggcctccttcatcgaggtgaagacatgtacctggcccaaaagccacacactgtggtctaatggggtgctcgaatccgagatgattatcccgaagatttacggaggccctatcagccagcataactatagacccgggtacttcacccagacggctggaccttggcacctgggcaaacttgagctggactttgatctctgcgaagggaccacagtcgtggttgacgagcactgcggaaatcgcggcccctctctgcggaccacaaccgtgacgggcaagattatccatgaatggtgttgcagaagctgtacactgcctccccttcggttccgcggggaggatggatgctggtacggcatggagatcagaccggtcaaagaaaaggaggaaaacctcgtgcggtccatggttagcgccgggtctggagaggtggactcctttagcctgggcattctgtgtgcgtccatcatgattgaagaggtcatgagatctcgctggagccggaagatgctcatgaccgggacactggctgtgttccttctgctcatcatgggacaactgacctggaatgacctgattagactttgcatcatggttggcgccaacgcctccgatcgcatgggcatggggaccacatatctggctctcatggccacgtttaaaatgagacctatgttcgcggtgggactgctctttcggcgcctgacctctagagaggtccttctgctcacaattggcctgagcctggtggcttccgtggaacttcccaactctctggaggaactcggggacggactggccatgggcatcatgatgctcaagctgcttaccgagttccagccccaccagctgtggacaaccctcctgagcctgacgtttatcaaaacaaccctttccctggattacgcctggaagaccacagctatggccctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggctattgggatcgtgagcatcctgctctcttccctgctcaagaatgacgtgcccctggccggacctcttattgcgggcgggatgctgatcgcctgttatgtcattagcggatccagcgctgatctgtctctcgagaaagccgctgaagtgagctgggagcaagaagccgagcattccggcacatctcacaacatcctggttgaagtgcaggacgatgggaccatgaagattaaagacgaggagcgcgatgacacgcttaccatcctgctcaaggccacactgctcgctgtcagcggagtgtaccccatgtccatccctgcgaccctgtttctttggtatttctggcagaaaaagaagcagagatctggcgttctgtgggatacacccagcccgcctgaagtggagcgggccgtcctggacgatggcatttaccgcatcctccaaagagggctgcttggacggtcccaggtgggcgtcggggtgttccaggacggagtttttcataccatgtggcacgtgacacgcggcgctgtcctgatgtatcaggggaaaagactcgaaccctcttgggccagcgtgaagaaagacctgatttcctacggaggcggctggcggttccaagggagctggaatacgggagaggaggttcaggtgatcgccgtcgaacctggcaagaaccccaaaaatgtgcagaccacaccggggacctttaagacccctgagggagaagtgggcgctattgccctcgatttcaagcccgggacatctggatcccctatcgttaacagagagggcaaaattgtcggcctgtacgggaatggagtggtgacgaccagcggcacatatgtctctgcgatcgctcaagccaaggcctcccaggaagggccccttcccgagatcgaggacgaagtgtttaaaaagcgcaacctgaccattatggatctgcaccctggaagcggcaaaacacggagatacctcccggctatcgttcgcgaggccattaagcggaagctgagaacccttatcctggcgcccacgcgcgtggtcgcttccgaaatggccgaggccctcaaagggatgcctattcggtatcagacaaccgctgtgaagtctgaacataccggcagagagatcgttgacctgatgtgccacgccacattcaccatgcgcctgctcagccccgtgcgggtccctaattacaacatgatcattatggatgaggctcattttacagaccccgcctccatcgcggccagaggatatattagcacccgggtgggcatgggggaagctgccgctatcttcatgacggccacacctccgggatctgttgaggcctttccccagtccaatgctgtgattcaagatgaagagcgcgacatccctgaaagaagctggaactctggctacgattggatcaccgacttccccgggaaaacagtctggtttgtgcctagcattaagtccggaaatgatatcgcgaactgtcttcggaaaaacggcaagcgcgtgattcagctgtctagaaagaccttcgacacggagtatcagaaaaccaagaataacgactgggattacgtcgttacaaccgacatcagcgagatgggggccaatttccgggctgatagagtgattgacccccgccggtgcctgaaaccggtgatcctcaaggatggccctgaaagagtcattctggccggacccatgcccgtgacagttgcctccgctgcccagcgccggggcagaatcgggcgcaaccaaaataaagagggagaccagtacgtgtatatgggccagcctcttaacaatgatgaagaccacgcgcattggaccgaggctaagatgctgctcgataacatcaatacacccgaggggattatccctgccctgtttgaaccggagcgggaaaagtctgccgctattgacggagagtacagactgcgcggcgaagccagaaaaaccttcgtcgagctcatgcggcgcggggatcttcccgtgtggctgagctataaggttgcgtccgagggctttcagtacagcgacagacggtggtgcttcgatggagaacgcaacaatcaagtgctggaggaaaacatggacgtcgagatctggacgaaagaaggcgagagaaagaaactccggcctagatggctggacgcccgcacatattctgatccccttgctctgcgggagtttaaggaattcgccgctgggagacgctccgtgagcggagacctcattctggagatcggcaaactgcctcagcacctcacccttcgggcccagaatgctctggataacctggtcatgctccacaattccgaacaggggggaaaggcctacagacatgcgatggaggaactgcccgacaccatcgagacacttatgctgctcgccctgattgctgtgctgaccggcggcgttacactctttttcctttctgggaagggactgggcaaaacgagcatcgggctgctctgtgtgaccgcctcctctgctctgctttggatggccagcgtggagccgcactggattgccgcttccatcattctggaatttttcctcatggtcctgctgatccctgagcccgatcggcaacgcacacctcaggacaaccagctcgcgtatgttgtgatcggacttctgtttatgattctgaccgtggccgctaacgaaatgggcctcctggagacaaccaagaaagatcttgggatcggacatgtcgccgccgagaatcaccaacacgctacgatgctggacgtggatctcagacccgccagcgcgtggaccctgtacgccgttgctacaaccgtgattacacctatgatgcggcataccatcgaaaacacgacagccaatatttctctgaccgctatcgccaaccaggcggccattctcatgggccttgacaagggctggcccatctccaaaatggatatcggggtcccgctgctggctctcggatgctacagccaggtgaatcctctgacacttaccgccgctgtcctgatgctcgtggcccactatgctattatcggccccgggctgcaggccaaggcgacccgcgaggcccaaaagagaacagctgccggaattatgaaaaaccccacggttgacggcatcgtggctattgatctggaccctgtcgtgtacgacgccaagttcgaaaaacagctcgggcagatcatgcttctgatcctgtgtacctctcagattctcctgatgcggacaacctgggccctttgcgagtccatcacactggcgaccggaccgctcacgacactgtgggaaggcagccccggcaagttttggaataccaccattgctgtttctatggccaacatcttccgcgggagctatctggctggagccggcctcgccttctcccttatgaaatctctggggggaggcagacgggggacaggagctcaaggcgagaccctgggcgagaagtggaagcgccagctcaatcagctgagcaaatccgaatttaacacatacaagagaagcgggattatggaggtggatcggtccgaagccaaagagggacttaagagaggcgaaacgaccaaacatgcggtctctcgcgggacagccaagctgcggtggttcgtggagagaaatctcgtgaagcctgagggaaaagttatcgacctgggctgtgggcgcggaggctggagctattactgcgctggcctgaagaaagtcaccgaagtgaaggggtatacaaaaggaggccccgggcacgaggaacctatccccatggccacctacggatggaacctcgtgaagcttcattccggcaaagatgtctttttcatgcctccggagaagtgtgacacgctgctgtgcgatattggggaatctagccccaatcctaccatcgaggagggacggacactcagagttctgaagatggtggaaccctggcttcgcggcaaccagttttgtattaaaatcctgaatccttacatgccctccgtggtcgagaccctcgaacaaatgcagcggaagcacggcgggatgctggtgagaaacccgctgtctcgcaatagcacacacgagatgtattgggtttcctgcggaaccggcaacattgtgagcgctgtcaacatgacatctcggatgctcctgaatagattcaccatggcccatcgcaaacctacgtttgagcgggacgtggatcttggggcgggaacaagacacgttgccgtggaacccgaggtcgctaacctggacatcattggccagcgcatcgaaaatatcaagaacgagcataaatccacctggcactacgatgaagacaatccctataagacctgggcctaccacgggagctatgaggtgaagccttctggatccgctagctctatggtgaacggcgtcgttagactcctgacaaaaccctgggatgtgattcctatggtgacgcaaatcgccatgaccgacacaaccccgttcggccagcagcgggtctttaaggagaaagtggacacacgcacccccagagctaagcgggggacaacccagattatggaagttacggccaaatggctttggggattcctgtccagaaataagaagcctcggatctgtacccgcgaggaatttacaagaaaagtgcggagcaacgcggccattggcgctgtcttcgtggatgagaatcaatggaactccgccaaggaagctgttgaggacgagcgcttttgggatctcgtgcatagagaacgggagctgcacaaacaggggaagtgcgccacctgcgtctacaatatgatgggaaaacgcgaaaagaagctgggcgagttcgggaaagccaagggcagcagagcgatctggtatatgtggctcggagctcggttcctggaatttgaggcccttggcttcatgaacgaggaccattggttttctcgcgaaaatagcctgtccggggtggagggagaaggcctccacaaactggggtacatccttagagatatttctaagatccccggaggcaacatgtacgccgacgatacagctgggtgggacacccggattacggaggatgacctgcagaatgaggccaaaatcacagatattatggaacctgagcatgctctcctggccaccagcatcttcaagctgacatatcagaacaaagttgtgcgcgtccaaagacccgcgaagaacggcaccgtgatggacgtcatctcccggcgcgatcagagaggatctggccaggtggggacgtacggactcaatacctttacaaacatggaagttcagctgattcggcaaatggagagcgaaggcatcttccttccgtccgagctggagacccctaatctcgccgaaagagtgctggactggcttgagaagcacggggctgaacgcctgaaacggatggccatttctggagacgattgtgtcgtgaagcccatcgacgatagatttgctacagccctcaccgcgctgaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctcgtgggacgcgcccgggttagccagggcgctgggtggtctctgagagagacagcctgccttggaaagtcctatgctcaaatgtggcagctgatgtacttccatcgccgggatctcagactggccgctaatgccatttgtagcgcggtgccggtcgactgggtgcctacctctcgcacgacatggtccatccacgcccaccatcagtggatgaccaccgaagatatgcttagcgtctggaaccgggtgtggattgaggaaaatccctggatggaggacaaaacacacgtttcctcttgggaagaggtgccctatctgggcaagagagaggaccagtggtgcgggagcctcatcggactgaccgctcgggccacatgggccacgaacattcaagtcgctatcaatcaggtgagacgcctgattggcaacgaaaattacctcgattatatgacctccatgaaacggtttaagaacgagagcgaccctgaaggggccctgtggtga

SEQ ID NO: 18612 - RNA, 9879 nt, synthetic construct
  misc_feature 1..9879: note = derived and/or modified CDS sequence (opt5) from DENV-1__GQ868510__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgggcaccgcagagagaagcggtctgtcgccctggctcctcatgtgggactcggcctggagacacgcaccgaaacgtggatgagctccgagggcgcctggaaacagattcagagagttgaaacatgggctcttcggcaccccgggttcaccgtgatcgccctgtttctcgcgcatgccattggaacatctatcacccaaaagggcatcattttcatcctgcttatgctggtcacccctagcatggctatgcgctgcgtggggattggaaacagagactttgttgagggcctctccggggccacatgggtggatgtcgtgctggagcacggaagctgtgtgacgaccatggctaagaataaacccacactggacatcgaactcctgaagaccgaggtcacaaaccctgccattcttcggaaactgtgcatcgaagcgaagatttctaataccacgacagattcccgctgtccgacccagggcgaggccaccctcgttgaagagcaggacgctaacttcgtgtgcagacggacatttgtggatcgcggctgggggaatggatgtggcctgttcgggaaaggaagccttctgacctgcgccaagtttaagtgcgtcacaaaactcgagggcaagatcgtgcagtacgaaaacctgaaatattctgttatcgtgacggtccacaccggggaccaacatcaggtgggaaatgagacaaccgaacacggcacaattgctaccatcacgccccaggcccctacctccgagattcagctgacagattacggcgccctcaccctggactgtagccccagaacagggcttgacttcaacgaaatggttctgctcaccatgaaggagaaatcttggctggtgcataagcaatggtttcttgatctgcctctcccctggacgtccggagctagcacatcccaggagacctggaatcggcaggacctgctggtcacattcaaaaccgcgcacgccaagaagcaagaagtggtcgtgctcggctctcaggagggggctatgcacaccgccctgacaggagccacggaaatccagaccagcggcacaaccacaatttttgctgggcatcttaaatgccgcctgaagatggataaactcaccctgaagggcacgtcctatgttatgtgtacaggaagcttcaaactggagaaggaagtggccgagacccagcacggcaccgtccttgtgcaagttaagtacgaggggacagacgcgccgtgcaaaatccctttctctacccaggatgaaaagggagtgacacagaacggcagactcatcacggctaatcccattgtcaccgacaaagagaagcctgtgaacatcgaaacagagcccccctttggggagtcctatattgtggttggagccggcgaaaaagccctgaagctgagctggttcaagaaagggtctagcatcggcaagatgtttgaggctaccgcccggggagctagacgcatggccattctcggcgatacagcgtgggacttcgggtccatcggaggcgtctttacctctgtggggaaactggtgcatcaggtcttcggaacggcctacggcgtgctttttagcggggtttcctggaccatgaagatcggcattggaatcctgctcacatggctgggcctgaatagccggtctacctcccttagcatgacatgtattgctgtggggatggtcaccctctacctgggagtgatggttcaagccgattctggctgcgtgatcaactggaaagggagagaactgaagtgtggatccggcattttcgtcacaaacgaggtgcacacctggacggaacagtataagtttcaggctgacagccctaaacgcctctccgccgcgatcgggaaggcctgggaggagggcgtttgcggaattcggtctgctacaagactggaaaatatcatgtggaaacagatcagcaacgagcttaatcatattctgctcgaaaacgatatgaagttcaccgtggtcgtgggcgacgccaatgggatcctggctcaaggaaaaaagatgattcgcccgcagcccatggagcacaaatactcctggaagtcttggggcaaggccaaaatcattggggccgacatccagaacaccacatttatcattgatggacctgacacccccgaatgtcctgatatccagcgggcttggaatatttgggaggtggaggactatggcttcggcatctttacgacaaacatttggctgaagcttagagatagctacacccaaatgtgcgaccaccgcctcatgtccgcggccatcaaagatagcaaggctgtccatgccgacatggggtattggatcgaatctgagaaaaatgaaacatggaagctggcccgggcttccttcattgaggttaagacctgtacatggcccaaaagccacaccctgtggtctaacggagtgctcgaatccgagatgatcattccgaagatctacggcgggcctattagccagcataattatagacccggatacttcacgcagaccgccggcccttggcacctggggaaacttgagctggattttgacctctgcgaaggaacaaccgtggtcgtggatgagcactgcggcaaccgcggcccctctctgcggacaaccacggttacagggaagatcatccatgaatggtgttgcagaagctgtaccctgcctccccttcggttccgcggagaggacggctgctggtacgggatggagattagaccggtgaaagaaaaggaggaaaatctcgtccggtccatggtgagcgcgggatctggcgaggttgattcctttagcctggggatcctgtgtgcttccattatgatcgaagaggtgatgagatctcgctggagccggaagatgctcatgacaggaaccctggccgtcttccttctgctcattatgggccaactgacctggaaagacctgatcagactttgcattatggtgggcgccaacgcttccgaccgcatggggatgggaacaacgtatctggccctcatggcgacctttaagatgagacctatgttcgctgttggcctgctctttcggcgcctgacatctagagaggtgcttctgctcaccatcgggctgagcctggtcgcctccgtggaacttcccaattctctggaggaactcggagatggcctggccatggggatcatgatgctcaaactgcttacagagttccagccccaccagctgtggaccacgctcctgagcctgacatttattaagaccaccctttccctggactacgcttggaaaacaaccgccatggctctcagcatcgtgtctctgttccctctctgtctgtccacaacgagccagaagaccacatggcttccggtcctgctgggatctctcggctgcaagcccctgaccatgtttcttattacagaaaacaaaatctggggccggaagtcctggcctctgaacgaggggattatggccatcggaatcgttagcattctcctgtcttccctcctgaaaaatgatgtgccccttgcgggccctctgatcgccgggggaatgctgattgcttgttatgtgatcagcggctccagcgccgacctctctctggagaaggctgccgaagtcagctgggagcaagaagccgagcattccgggacctctcacaacattcttgtggaagttcaggatgacggaacgatgaaaatcaaggatgaggagcgcgacgataccctgacaatcctcctgaaagctaccctcctggcggtgagcggcgtctaccccatgtccattcctgccacacttttcgtgtggtatttttggcagaagaagaaacagagatctggcgttctgtgggacacccccagcccgcctgaagtggagcgggctgtcctggatgacgggatctaccgcattctccaaagaggactgcttggccggtcccaggtgggggtcggagtgttccaggatggcgttttccatacaatgtggcacgtgacgcgcggggccgtcctgatgtatcagggaaagagactcgaaccctcttgggccagcgtgaaaaaggacctgatctcctacggcggcgggtggcggtttcaaggaagctggaataccggcgaggaggttcaggtgattgctgtcgaacctgggaaaaaccccaagaatgtgcagacaaccccgggaaccttcaagacacctgagggcgaagtgggggccatcgcgctcgactttaaacccggaacgtctggctcccctattgttaacagagagggcaagatcgtcgggctgtacggaaatggcgtggtgaccacaagcgggacctatgtctctgctatcgcccaagccaaagcttcccaggaaggaccccttcccgagattgaggatgaagtgttcaagaaacgcaacctgacaatcatggacctgcaccctggcagcgggaagacccggagatacctcccggccattgttcgcgaggcgatcaagcggaaactgagaacgcttattctggctcccacacgcgtggtcgcctccgaaatggccgaggctctcaagggcatgcctatccggtatcagaccaccgccgtgaaatctgaacatacaggaagagagatcgttgatctgatgtgccacgctacctttacaatgcgcctgctcagccccgtgcgggtccctaattacaacatgattatcatggacgaggcccatttcaccgatcccgcgtccattgccgctagaggctatatcagcacgcgggtggggatgggagaagccgctgccatttttatgacagccacccctccgggctctgttgaggctttcccccagtccaatgcggtgatccaagacgaagagcgcgatatccctgaaagaagctggaactctgggtacgactggattacagattttcccggaaagaccgtctggttcgtgcctagcatcaaatccggcaatgacattgccaactgtcttcggaagaatgggaagcgcgtgatccagctgtctagaaaaacgtttgataccgagtatcagaagacaaaaaacaacgactgggactacgtcgttaccacagatattagcgagatgggcgctaatttccgggccgacagagtgatcgatccccgccggtgcctgaagccggtgattctcaaagacggacctgaaagagtcatcctggccggccccatgcccgtgaccgttgcttccgccgcgcagcgccgggggagaatcggacgcaaccaaaataaggagggcgatcagtacgtgtatatggggcagcctcttaacaatgacgaagatcacgctcattggacagaggccaagatgctgctcgacaacattaatacccccgagggaatcattcctgccctgttcgaaccggagcgggaaaaatctgctgccatcgatggcgagtacagactgcgcggggaagcgagaaagacgtttgtcgagctcatgcggcgcggcgaccttcccgtgtggctgagctataaagttgcctccgagggattccagtacagcgatagacggtggtgctttgacggcgaacgcaacaatcaagtgctggaggaaaacatggatgtcgagatttggacaaaggaaggggagagaaaaaagctccggcctagatggctggacgctcgcacctattctgacccccttgccctgcgggagttcaaagaatttgctgccggaagacgctccgtgagcggcgatctcatcctggagatcgggaagctgcctcagcacctcacccttcgggctcagaatgccctggacaacctggtcatgctccacaattccgaacagggaggcaaggcgtacagacatgccatggaggaactgcccgatacaattgagacccttatgctgctcgctctgatcgccgtgctgacaggcggggttacgctcttctttctttctggaaaaggcctggggaagaccagcattggactgctctgtgtgacagcttcctctgccctgctttggatggccagcgtggagccgcactggatcgctgcgtccattatcctggaattctttctcatggtcctgctgatccctgagcccgaccggcaacgcacccctcaggataaccagctcgcctatgttgtgattggccttctgttcatgatcctgacagtggctgccaatgaaatggggctcctggagaccacgaaaaaggaccttggaattggccatgtcgccgctgagaaccaccaacacgccaccatgctggatgtggacctcagacccgcgagcgcctggacactgtacgctgttgccaccacagtgatcacccctatgatgcggcatacgattgaaaacacaaccgctaatatctctctgacagccattgcgaaccaggccgctatcctcatgggccttgataaagggtggcccatctccaagatggacattggagtcccgctgctggccctcggctgctacagccaggtgaatcctctgacccttaccgctgccgtcctgatgctcgtggctcactatgccatcattgggcccggactgcaggcgaaggccacacgcgaggctcaaaaaagaacggccgctggcatcatgaagaaccccaccgttgatgggattgtggccatcgacctggatcctgtcgtgtacgacgccaaatttgaaaagcagctcggacagatcatgcttctgattctgtgtacatctcagatcctcctgatgcggaccacatgggcgctttgcgagtccattaccctggctacgggcccgctcacaaccctgtgggaaggcagccccgggaaattctggaataccacaatcgccgtttctatggctaacatttttcgcggaagctatctggccggcgccgggctcgctttctcccttatgaagtctctgggaggcgggagacggggaaccggcgcccaaggcgagacactgggggagaagtggaaacgccagctcaatcagctgagcaagtccgaattcaacacgtacaaaagaagcggaatcatggaggtggaccggtccgaagcgaaggagggccttaaaagaggggaaaccacaaagcatgccgtctctcgcggaaccgctaagctgcggtggtttgtggagagaaatctcgtgaaacctgagggcaaggttatcgatctggggtgtggacgcggcggctggagctattactgcgccgggctgaaaaaggtcacagaagtgaaaggatataccaagggcgggcccggacacgaggaacctattcccatggctacgtacggctggaacctcgtgaaacttcattccgggaaggacgtcttctttatgcctccggagaagtgtgataccctgctgtgcgacatcggagaatctagccccaatcctacaattgaggagggccggaccctcagagttctgaaaatggtggaaccctggcttcgcggcaaccagttctgtatcaagattctgaatccttacatgccctccgtggtcgagacactcgaacaaatgcagcggaaacacgggggaatgctggtgagaaacccgctgtctcgcaatagcacccacgagatgtattgggtttcctgcggcacagggaacatcgtgagcgccgtcaatatgacctctcggatgctcctgaacagatttacgatggcgcatcgcaagcctacatacgagcgggatgtggaccttggagccggcaccagacacgttgctgtggaacccgaggtcgccaacctggatattatcgggcagcgcatcgaaaatattaaaaacgagcataagtccacctggcactatgacgaagataatccctacaagacatgggcttatcacggaagctacgaggtgaaaccttctggctccgccagctctatggtgaacggcgtcgttagactcctgacgaagccctgggacgtgatccctatggtgacccaaattgctatgacagataccacaccgttcgggcagcagcgggtctttaaagagaaggtggacacccgcacacccagagccaaacggggaaccacgcagatcatggaagttaccgcgaagtggctttggggcttcctgtccagaaataagaaacctcggatttgtacacgcgaggaatttaccagaaaggtgcggagcaacgccgctatcggggccgtcttcgtggacgagaatcaatggaactccgctaaagaagccgttgaggatgagcgcttttgggacctcgtgcatagagaacgggagctgcacaagcagggaaaatgcgccacatgcgtctataatatgatgggcaagcgcgaaaagaaactgggggagttcggcaaggcgaaaggaagcagagctatctggtacatgtggctcggcgcccggtttctggaattcgaggcccttgggttcatgaacgaggatcattggttttctcgcgaaaatagcctgtccggagtggagggcgaagggctccacaagctgggatacattcttagagacatctctaaaattcccggcgggaacatgtatgctgatgacaccgccggctgggatacgcggatcacagaggacgatctgcagaatgaggctaagattaccgacatcatggaacctgagcatgccctcctggcgacaagcatcttcaaactgacctaccagaacaaggttgtgcgcgtccaaagacccgccaagaatggaacggtgatggatgtcatttcccggcgcgaccagagaggctctgggcaggtgggaacctatggcctcaacacatttaccaacatggaagttcagctgatccggcaaatggagagcgaagggattttccttccgtccgagctggagacacctaatctcgctgaaagagtgctggattggcttggaaaacacggcgccgagcgcctgaagcggatggctatctctggggacgactgtgtcgtgaaacccattgatgacagatttgccaccgcgctcacagccctgaacgatatgggcaaggtgcgcaaagacatccctcagtgggaacccagcaagggatggaatgattggcagcaggttcctttctgctcccaccattttcaccaactgatcatgaaggacggccgggagattgtggtcccctgtagaaaccaggatgaactcgtggggcgcgctcgggttagccagggagccggctggtctctgagagagaccgcttgccttgggaaatcctacgcccaaatgtggcagctgatgtatttccatcgccgggacctcagactggctgccaatgcgatctgtagcgccgtgccggtcgattgggtgcctacgtctcgcacaacctggtccattcacgctcaccatcagtggatgaccacagaggacatgcttagcgtctggaaccgggtgtggatcgaagagaatccctggatggaagataagacccacgtttcctcttgggaggaagtgccctacctgggaaaaagagaggaccagtggtgcggcagcctcattgggctgacagcccgggccacgtgggctaccaacatccaagtcgccattaatcaggtgagacgcctgatcggcaacgagaattatctcgactacatgacatccatgaagcggtttaaaaacgaaagcgatcctgagggagcgctgtggtga

SEQ ID NO: 18613 - RNA, 9879 nt, synthetic construct
  misc_feature 1..9879: note = derived and/or modified CDS sequence (opt5) from DENV-1__GQ868511__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttacctgccgcctgaaaatggacaagctcacgctgaaagggacatcctatgttatgtgtaccggcagcttcaagctggagaaagaagtggccgagacccagcacggaacagtccttgtgcaagttaagtacgagggcaccgatgcgccgtgcaagatccctttctctacacaggacgaaaaaggggtgacgcagaacggaagactcatcaccgctaatcccattgtcacagataaggagaaacctgtgaacatcgaaaccgagcccccctttggcgagtcctatattgtggttggggccggagaaaaggccctgaaactgagctggttcaagaagggctctagcatcgggaaaatgtttgaggctacagcccggggcgctagacgcatggccattctcggagacaccgcgtgggatttcggctccatcgggggagtctttacgtctgtgggcaagctggtgcatcaggtcttcgggaccgcctacggagtgctttttagcggcgtttcctggacaatgaaaatcgggattggcatcctgctcacctggctgggactgaatagccggtctacatcccttagcatgacctgtattgctgtgggcatggtcacactctacctgggggtgatggttcaagccgactctggatgcgtgatcaactggaagggcagagaactgaaatgtgggtccggaattttcgtcaccaacgaggtgcacacgtggacagaacagtataagtttcaggctgatagccctaagcgcctctccgccgcgatcggcaaagcctgggaggagggggtttgcggcattcggtctgctaccagactggaaaatatcatgtggaagcagatcagcaacgagcttaatcatattctgctcgaaaacgacatgaaattcaccgtggtcgtgggagacgccaatggcatcctggctcaagggaagaaaatgattcgcccgcagcccatggagcacaagtactcctggaaatcttggggaaaggccaagatcattggcgccgatatccagaacacaacctttatcattgacgggcctgatacgcccgaatgtcctgacaatcagcgggcttggaacatctgggaggtggaggattatggattcggcatttttacaaccaatatctggctgaaacttagagacagctacacacaaatgtgcgatcaccgcctcatgtccgcggccattaaggacagcaaagctgtccatgccgatatgggctattggatcgaatctgagaagaacgaaacctggaaactggcccgggcttccttcatcgaggttaagacatgtacctggcccaagagccacacgctgtggtctaatggggtgctcgaatccgagatgattatcccgaaaatttacggaggccctatcagccagcataactatagacccgggtacttcacccagacagccggaccttggcacctgggcaagcttgagctggactttgatctctgcgaagggaccacagtggtcgtggacgagcactgcggaaatcgcggcccctctctgcggaccacgacagttaccggcaaaattatccatgaatggtgttgcagaagctgtacactgcctccccttcggttccgcggggaggatggatgctggtacggcatggagatcagaccggtgaaggaaaaagaggaaaacctcgtccggtccatggtgagcgcggggtctggagaggttgactcctttagcctgggcattctgtgtgcttccatcatgattgaagaggtgatgagatctcgctggagccggaagatgctcatgaccgggaccctggccgtcttccttctgctcgtgatgggacaactgacatggaatgacctgatcagactttgcattatggttggcgccaacgcttccgatcgcatgggcatggggacgacctatctggccctcatggcgacatttaagatgagacctatgttcgctgtgggactgctctttcggcgcctgacctctagagaggtccttctgctcacaatcggcctgagcctggtggcctccgtggaacttcccaactctctggaggaactcggggacggactggccatgggcattatgatgctcaaactgcttaccgagttccagccccaccagctgtggacgacactcctgagcctgacctttatcaagaccacactttccctggattacgcttggaaaaccacagccatggctctcagcatcgtctctctgttccctctctgtctgtccacgaccagccagaagacaacctggcttccggttctgctggggtcttttggatgcaaacccctcacaatgttcctgattaccgaaaataagatctggggccggaagtcctggcctcttaacgagggcattatggccatcgggattgtgagcatcctgctctcttccctgctcaaaaatgacgtgcccctggcgggacctcttatcgccggcgggatgctgattgcttgttatgtcatcagcggatccagcgccgatctgtctctcgagaaggctgccgaagtgagctgggagcaagaagccgagcattccggcacgtctcacaacattctggttgaagtgcaggacgatgggaccatgaaaatcaaggacgaggagcgcgatgacacacttaccattctgctcaaagctacactgctcgcggtcagcggagtgtaccccatgtccatccctgccaccctgtttgtttggtatttctggcagaagaaaaagcagagatctggcgtgctttgggatacacccagcccgcctgaagtcgagcgggctgtgctggacgatggcatctaccgcattctgcaaagagggctcctgggacggtcccaggtcggcgtgggggttttccaggacggagtgtttcatacgatgtggcacgtcacccgcggcgccgtgcttatgtatcaggggaagagactggaaccctcttgggccagcgttaaaaaggacctcatctcctacggaggcggctggcggttccaagggagctggaatacaggagaggaggtgcaggtcattgctgtggaacctggcaaaaaccccaagaatgtgcagaccaccccggggacatttaaaacgcctgagggagaagttggcgccatcgcgctggatttcaagcccgggacctctggatcccctattgtcaacagagagggcaagatcgtgggcctctacgggaatggagtggtcacaaccagcggcacatatgtgtctgctattgcccaagccaaagcttcccaggaagggcccctgcccgagatcgaggacgaagtttttaagaaacgcaaccttaccatcatggatctgcaccctggaagcggcaagacgcggagatacctgccggccattgtgcgcgaggcgatcaaaaagaagctccggacactgattcttgctcccaccagagtcgtggcctccgaaatggccgaggctctgaaagggatgcctatccgctatcagaccacagccgttaagtctgaacataccggccgggagattgtggacctcatgtgccacgctacattcaccatgagactgctgagccccgtccgcgtgcctaattacaacatgatcatcatggatgaggcccattttacggaccccgcgtccattgccgctcggggatatatcagcacaagagttggcatgggggaagccgctgccattttcatgaccgccacacctccgggatctgtggaggcttttccccagtccaatgcggtcatccaagatgaagagcgggacattcctgaacgcagctggaactctggctacgattggatcaccgacttccccgggaaaacggtgtggtttgtgcctagcatcaagtccggaaatgatattgccaactgtctcagaaaaaacggcaagcgggtcatccagctttctcgcaagaccttcgacacagagtatcagaaaaccaagaataacgactgggattacgttgtgacaaccgacattagcgagatgggggctaatttcagagccgatcgggtgatcgaccccagacgctgcctgaaaccggtcattctgaaggatggccctgaacgggtgatcctcgccggacccatgcccgttacagtggcttccgccgcgcagagacgcggccggattgggagaaaccaaaataaagagggagaccagtacgtctatatgggccagcctctgaacaatgatgaagaccacgctcattggaccgaggccaagatgcttctggataacatcaatacgcccgaggggatcattcctgccctctttgaaccggagcgcgaaaagtctgctgccatcgacggagagtaccggctgagaggcgaagcgcgcaaaacattcgtggagctgatgagacggggggatctccccgtttggcttagctataaggtggcctccgagggctttcagtacagcgaccgcagatggtgcttcgatggagaacggaacaatcaagtcctggaggaaaacatggacgtggagatttggaccaaagaaggcgagcgcaagaaactgagacctcggtggctcgacgctagaacctattctgatcccctggcccttcgcgagtttaaggaattcgctgccgggcggagatccgtcagcggagacctgatcctcgagattggcaaactgcctcagcacctgacactccgcgctcagaatgcccttgataacctggtgatgctgcacaattccgaacaggggggaaaggcgtaccggcatgccatggaggaactccccgacaccatcgagacactgatgcttctggctctcatcgccgttctgacgggcggcgtgaccctgtttttcctctctgggaagggacttggcaaaacaagcattgggctgctgtgtgtgaccgcttcctctgccctcctgtggatggccagcgtcgagccgcactggatcgctgcgtccattatccttgaatttttcctgatggttctcctgattcctgagcccgatagacaacggacacctcaggacaaccagctggcctatgtggtgatcggactcctttttatgatcctgaccgtcgctgccaacgaaatgggcctgctcgagacgaccaagaaagatctggggattggacatgtggccgctgagaatcaccaacacgccacaatgcttgacgttgatctgcgccccgcgagcgcctggaccctctacgctgtggccacaaccgtcatcacgcctatgatgagacatacaattgaaaacaccacagctaatatctctctgaccgccattgcgaaccaggccgctatcctgatgggcctcgacaagggctggcccatttccaaaatggatatcggggtgccgcttctggccctgggatgctacagccaggtcaatcctctcaccctgacagctgccgtgcttatgctggttgctcactatgccatcattggccccgggctccaggcgaaggccacgcgggaggctcaaaagcgcaccgccgctggaatcatgaaaaaccccacagtggacggcattgtcgccatcgatctggaccctgtggtttacgacgccaagttcgaaaaacagctggggcagattatgctccttatcctgtgtacctctcagatcctgctcatgagaacaacctgggcgctgtgcgagtccattacgcttgctacaggaccgctgaccaccctctgggaaggcagccccggcaagttttggaatacaaccatcgccgtgtctatggctaacattttccgggggagctatctggccggagccggcctggctttctccctcatgaaatctcttgggggaggccgcagagggacaggagcccaaggcgagacgctgggcgagaagtggaagcggcagctgaatcagctcagcaaatccgaatttaacgcgtacaagcgcagcgggatcatggaggtcgatagatccgaagccaaagagggactgaagcggggcgaaaccacaaaacatgctgtgtctagagggaccgccaagcttcgctggttcgtggagcggaatctggttaagcctgagggaaaagtcattgacctcggctgtgggagaggaggctggagctattactgcgctggcctgaagaaagtgacagaagtgaaggggtataccaaaggaggccccgggcacgaggaacctatccccatggccacgtacggatggaacctggtcaagctccattccggcaaagatgtttttttcatgcctccggagaagtgtgacacccttctgtgcgatatcggggaatctagccccaatcctacaattgaggagggacgcaccctgcgggtgctcaagatggtggaaccctggctgagaggcaaccagttttgtatcaaaattcttaatccttacatgccctccgtcgtggagacactggaacaaatgcagcgcaagcacggcgggatgctcgttcggaacccgctgtctagaaatagcacccacgagatgtattgggtgtcctgcggaacaggcaacatcgtcagcgcggtgaacatgacctctcgcatgctgctcaatcggttcacgatggcccatagaaaacctacatacgagcgcgacgttgatctgggggctggaacccggcacgtggccgtcgaacccgaggtggctaaccttgacattatcggccagagaattgaaaatatcaagaacgagcataaatccacctggcactatgatgaagacaatccctacaagacatgggcctatcacgggagctacgaggtgaagccttctggatccgctagctctatggtcaacggcgttgtgcgcctgctcacgaaaccctgggatgtgatccctatggtcacccaaattgccatgacagacaccacaccgtttggccagcagagagtgttcaaggagaaagttgacacccggacaccccgcgcgaagagagggaccacgcagatcatggaagtgaccgccaaatggctgtggggatttctttcccggaataagaagcctagaatttgtacacgggaggaattcacccgcaaagtcagaagcaacgctgccatcggcgctgtgtttgttgatgagaatcaatggaactccgccaaggaagccgtggaggacgagagcttctgggatctggtccataaagaacgggagctccacaagcaggggaaatgcgcgacatgcgtgtataatatgatgggaaagcgcgaaaagaaactgggcgagtttgggaaggctaaaggctctagagccatttggtacatgtggctgggagcccggttcctcgaattcgaggctctgggctttatgaacgaggaccattggttcagccgcgaaaattccctttctggggttgagggagaaggcctgcacaagctcgggtacatcctgagagatatcagcaaaattcccggaggcaacatgtatgccgacgataccgctgggtgggacacgcggatcacagaggatgaccttcagaatgaggccaagattaccgaaatcatggagcctgaacatgcgctgctcgccacatccatttttaaactgacctaccagaacaaggtggtccgcgtgcaaagacccgctaagaacggcacggtcatggatgtgatctctcggcgcgaccagagaggaagcggccaggttgggacctatggactgaatacattcaccaacatgggcgtgcagctcatccggcaaatggagtccgaagggatttttctgccgtctgagcttgagacacctaatctggccgaacgcgtcctcgattggctggagaaacacggagctgaaagacttaagcggatggccatcagcggcgacgactgtgtggtgaaacccattgatgacagattcgcgaccgccctgacagctctcaacgatatggggaaggttcgcaaagacatccctcagtgggagccctccaagggctggaatgattggcagcaggtgcctttttgcagccaccatttccaccaactgattatgaaggacggacgggaaatcgtcgtgccctgtagaaaccaggatgagctggttggccgcgcccgggtgtctcagggggctggatggtccctcagagagaccgcctgcctgggcaaaagctacgctcaaatgtggcagcttatgtattttcatcgccgggacctgagactcgccgcgaatgccatctgttctgctgtcccggtggattgggtccctacgtcccgcacaacctggagcattcacgcccaccatcagtggatgaccacagaagacatgctgtccgtgtggaaccgggtttggatcgaggaaaatccctggatggaggataagacccacgtgtctagctgggaagaggtcccctaccttgggaaaagagaggaccagtggtgcggatccctgattggcctcacagcccgcgctacgtgggccaccaacatccaagtggcgattaatcaggttcggagactgatcgggaacgaaaattatctggactacatgacaagcatgaagcggttcaaaaacgagtctgatcctgaaggcgctctctggtga

SEQ ID NO: 18614 - RNA, 9879 nt, synthetic construct
  misc_feature 1..9879: note = derived and/or modified CDS sequence (opt5) from DENV-1__GQ868512__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagtctgaacatacaggcagagagattgtcgacctcatgtgccacgccaccttcacaatgcgcctgctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctccggaaaaacggcaagcgcgttatccagctttctagaaagacgttcgacaccgagtatcagaaaacaaagaataacgactgggattacgtggtgaccacagacattagcgagatgggggccaatttccgggctgatagagtcatcgacccccgccggtgcctgaaaccggtgattctgaaggatggccctgaaagagttatcctcgccggacccatgcccgtgaccgtcgcctccgctgcccagcgccggggcagaattgggcgcaaccaaaataaagagggagaccagtacgtgtatatgggccagcctctgaacaatgatgaagaccacgcgcattggacagaggctaagatgcttctggataacatcaatacccccgaggggatcattcctgccctctttgaaccggagcgggaaaagtctgccgctatcgacggagagtacagactgcgcggcgaagccagaaaaacgttcgttgagctgatgcggcgcggggatctccccgtgtggcttagctataaggtcgcgtccgagggctttcagtacagcgacagacggtggtgcttcgatggagaacgcaacaatcaagtgctggaggaaaacatggacgtcgagatttggacaaaagaaggcgagagaaagaaactgcggcctagatggctcgacgcccgcacctattctgatcccctggctcttcgggagtttaaggaattcgccgctgggagacgctccgtgagcggagacctgatcctcgagattggcaaactgcctcagcacctgaccctccgggcccagaatgctcttgataacctggttatgctgcacaattccgaacaggggggaaaggcctacagacatgcgatggaggaactccccgacacaatcgagaccctgatgcttctggccctcatcgctgtgctgacaggcggcgtgacgctgtttttcctctctgggaagggacttggcaaaaccagcattgggctgctgtgtgtcacagcctcctctgctctcctgtggatggccagcgttgagccgcactggatcgccgcttccattatccttgaatttttcctgatggtgctcctgattcctgagcccgatcggcaacgcacccctcaggacaaccagctggcgtatgtggtcatcggactcctttttatgatcctgacagtggccgctaacgaaatgggcctgctcgagaccacgaagaaagatctggggattggacatgttgccgccgagaatcaccaacacgctaccatgcttgacgtggatctgagacccgccagcgcgtggacactctacgccgtcgctaccacagtgatcacccctatgatgcggcatacgattgaaaacacaaccgccaatatctctctgacagctattgccaaccaggcggccatcctgatgggcctcgacaagggctggcccatttccaaaatggatatcggggtcccgcttctggctctgggatgctacagccaggtgaatcctctcaccctgaccgccgctgttcttatgctggtggcccactatgctatcattggccccgggctccaggccaaggcgacacgcgaggcccaaaagagaacggctgccggaatcatgaaaaaccccaccgtcgacggcattgtggctatcgatctggaccctgttgtgtacgacgccaagttcgaaaaacagctggggcagattatgctccttatcctgtgtacatctcagatcctgctcatgcggaccacatgggccctgtgcgagtccattacccttgcgacgggaccgctgacaaccctctgggaaggcagccccggcaagttttggaataccacaatcgctgtctctatggccaacattttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggatcatggaggtggatcggtccgaagccaaagagggactgaagagaggcgaaaccacaaaacatgcggtgtctcgcgggaccgccaagcttcggtggttcgttgagagaaatctggtcaagcctgagggaaaagtgattgacctcggctgtgggcgcggaggctggagctattactgcgctggcctgaagaaagtgacagaagtcaaggggtataccaaaggaggccccgggcacgaggaacctatccccatggccacgtacggatggaacctggttaagctccattccggcaaagatgtgtttttcatgcctccggagaagtgtgacacccttctgtgcgatatcggggaatctagccccaatcctacaattgaggagggacggaccctgagagtgctcaagatggtcgaaccctggctgcgcggcaaccagttttgtatcaaaattcttaatccttacatgccctccgtggttgaggctctggaacaaatgcagcggaagcacggcgggatgctcgtgagaaacccgctgtctcgcaatagcacacacgagatgtattgggtctcctgcggaaccggcaacatcgtgagcgccgttaacatgacatctcggatgctgctcaatagattcaccatggcgcatcgcaaacctacgtacgagcgggacgtggatctgggggccggaacaagacacgtcgctgtggaacccgaggtggccaaccttgacattatcggccagcgcattgaaaatatcaagaacgagcataaatccacctggcactatgatgaagacaatccctacaagacctgggcttatcacgggagctacgaggtcaagccttctggatccgccagctctatggttaacggcgtggtgagactgctcacaaaaccctgggatgtcatccctatggtgacgcaaattgctatgaccgacacaaccccgtttggccagcagcgggttttcaaggagaaagtggacacacgcacccccagagccaagcgggggacaacccagatcatggaagtcacggcgaaatggctgtggggatttctttccagaaataagaagcctcggatttgtacccgcgaggaattcacaagaaaagtgcggagcaacgccgctatcggcgccgtttttgtggatgagaatcaatggaactccgctaaggaagccgtcgaggacgagcgcttctgggatctggtgcatagagaacgggagctccacaaacaggggaagtgcgccacctgcgtttataatatgatgggaaaacgcgaaaagaagctgggcgagtttgggaaagcgaagggcagcagagctatttggtacatgtggctgggagcccggttcctcgaattcgaggccctgggctttatgaacgaggaccattggttctctcgcgaaaatagcctttccggggtggagggagaaggcctgcacaaactcgggtacatcctgagagatatctctaagattcccggaggcaacatgtatgctgacgatacagccgggtgggacacccggatcacggaggatgaccttcagaatgaggctaaaattacagaaatcatggagcctgaacatgccctgctcgcgaccagcatttttaagctgacataccagaacaaagtcgtgcgcgtccaaagacccgccaagaacggcaccgtgatggatgttatctcccggcgcgaccagagaggatctggccaggtggggacgtatggactgaataccttcacaaacatggaggtccagctcatccggcaaatggaaagcgagggcatttttctgccgtccgagcttgaaacccctaatctggctgagagagtgctcgattggctggaaaagcacggggccgagcgccttaaacggatggctatctctggagacgactgtgtggttaagcccattgatgacagattcgccacagcgctgaccgccctcaacgatatgggcaaagtgcgcaaggacatccctcagtgggaacccagcaaagggtggaatgattggcagcaggtccctttttgctcccaccatttccaccaactgattatgaaggacggccgggagatcgtggttccctgtagaaaccaggatgagctggtgggacgcgctcgggtcagccagggcgccgggtggtctctcagagaaacagcttgcctgggaaagtcctacgcccaaatgtggcagcttatgtattttcatcgccgggacctgagactcgctgccaatgcgatctgtagcgccgtgccggtcgattgggtgcctacctctcgcacgacatggtccattcacgctcaccatcagtggatgaccaccgaggacatgctgagcgtttggaaccgggtgtggatcgaagagaatccctggatggaagataaaacacacgtctcctcttgggaggaggtgccctaccttggcaagagagaagaccagtggtgcgggagcctgattggactcaccgcccgggccacatgggctacgaacatccaagttgccattaatcaggtgagacgcctgatcggcaacgagaattatctggactacatgacctccatgaaacggttcaagaacgaaagcgatcctgagggggcgctctggtga

SEQ ID NO: 18615 - RNA, 9879 nt, synthetic construct
  misc_feature 1..9879: note = derived and/or modified CDS sequence (opt5) from DENV-1__GU131970__SS-prME
  source 1..9879: mol_type = other RNA
agcgtgaccatgctgctcatgctgcttcccacagctctggctttccacctcacgaccagaggcggggagcctcatatgatcgtctccaagcaggaacggggaaaatctctgctttttaagacaagcgccggcgttaatatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcacagaagagagaagcggtctgtcgccctggctcctcatgtggggctcggactggaaacacgcaccgagacgtggatgagctccgaaggcgcctggaaacagattcagagagttgagacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagactttgttgagggactctccggcgccacatgggtggatgtcgtgctggaacacgggagctgtgtgacgaccatggctaagaataaacccacactggacatcgagctcctgaagaccgaagtcacaaaccctgccattcttcggaaactgtgcatcgaggcgaagatttctaataccacgacagattcccgctgtccgacccagggagaagccaccctcgttgaggagcaggacgctaacttcgtgtgcagacggacatttgtggatcgcggctggggcaatgggtgtggactgttcggcaaagggagccttctgacctgcgccaagtttaagtgcgtcacaaaactcgaaggaaagatcgtgcagtacgagaacctgaaatattctgttatcgtgacggtccacaccggcgaccaacatcaggtggggaatgaaacaaccgagcacggaacaattgctaccatcacgccccaggcccctacctccgaaattcagctgacagattacggcgccctcaccctggactgtagccccagaacaggccttgacttcaacgagatggttctgctcaccatgaaggagaaatcttggctggtgcataagcaatggtttcttgatctgcctctcccctggacgtccggggctagcacatcccaggaaacctggaatcggcaggacctgctggtcacattcaaaaccgcgcacgccaagaagcaagaggtggtcgtgctcggatctcaggaaggcgctatgcacaccgccctgacaggggccacggagatccagaccagcggaacaaccacaatttttgctggccatcttaaatgccgcctgaagatggataaactcaccctgaaggggacgtcctatgttatgtgtacaggcagcttcaaactggaaaaggaggtggccgagacccagcacggaaccgtccttgtgcaagttaagtacgaaggcacagacgcgccgtgcaaaatccctttctctacccaggatgagaagggggtgacacagaacggaagactcatcacggctaatcccattgtcaccgacaaagaaaagcctgtgaacatcgagacagagccgccctttggcgaatcctatattgtggttggggccggagagaaagccctgaagctgagctggttcaagaaaggctctagcatcgggaagatgtttgaagctaccgcccggggcgctagacgcatggccattctcggagatacagcgtgggacttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgattctggatgcgtgatcaactggaaaggcagagagctgaagtgtgggtccggaattttcgtcacaaacgaagtgcacacctggacggagcagtataagtttcaggctgacagccctaaacgcctctccgccgcgatcggcaaggcctgggaggaaggggtttgcggcattcggtctgctacaagactggagaatatcatgtggaaacagatcagcaacgaacttaatcatattctgctcgagaacgatatgaagttcaccgtggtcgtgggagacgccaatggcatcctggctcaagggaaaaagaccattcgcccgcagcccatggaacacaaatactcctggaagtcttggggaaaggccaaaatcattggcgccgacatccagaacacaacctttatcattgatgggcctgacacgcccgagtgtcctgataatcagcgggcttggaacatctgggaggtggaagactatggattcggcatttttacaaccaatatctggctgaaacttagagatagctacacacaaatgtgcgaccaccgcctcatgtccgcggccattaaagatagcaaggctgtccatgccgacatgggctattggatcgagtctgagaagaatgagacctggaagctggcccgggcttccttcatcgaagttaagacatgtacctggcccaaaagccacacgctgtggtctaatggggtgctcgagtccgagatgattatcccgaagatttacggaggccctatcagccagcataactatagacccgggtacttcacccagacagccggaccttggcacctgggcaaacttgaactggattttgacctctgcgaggggaccacagtggtcgtggatgaacactgcggaaatcgcggcccctctctgcggaccacgacagttaccggcaagattatccatgagtggtgttgcagaagctgtacactgcctccccttcggttccgcggggaggacggatgctggtacggcatggaaatcagaccggtgaaagagaaggaagagaacctcgtccggtccatggtgagcgcggggtctggagaagttgattcctttagcctgggcattctgtgtgtgtccatcatgattgaggaggtcatgagatctcgctggagccggaagatgctcatgaccgggaccctggctgtgttccttctgctcatcatgggacaactgacatggaaagacctgattagactttgcatcatggttggcgccaatgcctccgaccgcatgggcatggggacgacctatctggctctcatggccacatttaagatgagacctatgttcgcggtgggactgctctttcggcgcctgacctctagagaagtccttctgctcacaattggcctgagcctggtggcttccgtggagcttcccaactctctggaagaactcggggatggactggccatgggcatcatgatgctcaaactgcttaccgagttccacccccatcagctgtggacgacactcctgagcctgacctttatcaagaccacactttccctggactacgcctggaaaaccacagctatggccctcagcattgtctctctgttccctctctgtctgtccacgaccagccagaagacaacctggcttccggttctgctggggtcttttggatgcaagcccctcacaatgttcctgatcaccgagaacaaaatttggggccggaagtcctggcctcttaatgagggcatcatggctattgggatcgtgagcatcctgctctcttccctgctcaaaaacgatgtgcccctggccggacctcttattgcgggcgggatgctgatcgcctgttatgtcattagcggatccagcgctgacctgtctctcgaaaaggccgctgaggtgagctgggaacaggaggccgaacactccggcacgtctcataatatcctggttgaggtgcaagatgacgggaccatgaaaattaaggatgaggaacgcgacgatacacttaccatcctgctcaaagccacactgctcgctgtcagcggagtgtaccccatgtccatccctgcgaccctgtttgtttggtatttctggcagaagaagaaacagagatctggcgtgctttgggacacacccagcccgcctgaggtcgaacgggccgtgctggatgacggcatttaccgcatcctgcagagagggctcctgggacggtcccaagtcggcgtgggggttttccaggatggagtgtttcacacgatgtggcacgtcacccgcggcgctgtgcttatgtatcaggggaagagactggagccctcttgggccagcgttaaaaaggacctcatttcctacggaggcggctggcggttccaggggagctggaacacaggagaggaagtgcaagtcatcgccgtggagcctggcaaaaatcccaagaacgtgcagaccaccccggggacatttaagacgcctgaaggagaggttggcgctattgccctggacttcaaacccgggacctctggatcccctatcgtcaatagagaaggcaagattgtgggcctctacgggaacggagtggtcacaaccagcggcacatatgtgtctgcgatcgctcaggccaaagcctcccaagaggggcccctgcccgagatcgaagatgaggtttttaagaaacgcaatcttaccattatggacctgcatcctggaagcggcaagacgcggagatacctgccggctatcgtgcgcgaagccattaagcggaaactcagaacactgatccttgcgcccacccgcgtcgtggcttccgagatggccgaagccctgaaggggatgcctattcggtatcagaccacagctgttaaatctgagcacaccggcagagagatcgtggatctcatgtgccatgccacattcaccatgcgcctgctgagccccgtccgggtgcctaactacaatatgatcattatggacgaagctcactttacggatcccgcctccatcgcggccagaggatatattagcacacgggttggcatgggggaggctgccgctatcttcatgaccgccacacctccgggatctgtggaagcctttccccagtccaacgctgtcattcaggacgaggaacgcgatatccctgagagaagctggaactctggctacgactggatcaccgatttccccgggaagacggtgtggtttgtgcctagcattaaatccggaaacgacatcgcgaattgtctccggaagaacggcaagcgcgtcattcaactttctagaaaaaccttcgatacagagtatcagaagaccaaaaacaatgactgggactacgttgtgacaaccgatatcagcgaaatgggggccaacttccgggctgacagagtgattgatccccgccggtgcctgaagccggtcatcctgaaagacggccctgagagagtgattctcgccggacccatgcccgttacagtggcctccgctgcccagcgccggggcagaatcgggcgcaatcagaacaaggaaggagatcaatacgtctatatgggccagcctctgaataacgacgaggatcatgcgcactggaccgaggctaagatgcttctggacaatatcaacacgcccgaagggattatccctgccctctttgagccggaacgggagaaatctgccgctattgatggagaatacagactgcgcggcgaggccagaaagacattcgtggagctgatgcggcgcggggacctccccgtttggcttagctataaagtggcgtccgaaggctttcagtacagcgatagacggtggtgcttcgacggagagcgcaataaccaggtcctggaagagaatatggatgtggaaatctggaccaaggagggcgagcgcaagaagctgcggcctagatggctcgacgcccgcacctattctgaccccctggcccttcgggaatttaaagagttcgccgctgggagacgctccgtcagcggagatctgattctcgaaatcggcaagctgcctcaacacctgacactccgggcccagaacgctcttgacaatctggtgatgctgcataactccgagcaagggggaaaggcctacagacacgcgatggaagaactccccgataccatcgagacactgatgcttctggccctcattgctgttctgacgggcggcgtgaccctgtttttcctctctgggaaaggacttggcaagacaagcatcgggctgctgtgtgtgaccgcctcctctgctctcctgtggatggccagcgtcgaaccgcattggattgccgcttccatcattcttgagtttttcctgatggttctcctgatccctgaacccgaccggcagcgcacacctcaagataatcagctggcgtatgtggtgatcggactcctttttatgattctgaccgtcgccgctaacgagatgggcctgctcgagacgaccaaaaaggacctggggatcggacacgtggccgccgaaaaccaccagcatgctacaatgcttgatgttgacctgagacccgccagcgcgtggaccctctacgccgtggctacaaccgtcattacgcctatgatgcggcacacaatcgagaataccacagccaacatttctctgaccgctatcgccaatcaagcggccattctgatgggcctcgataaaggctggcccatctccaagatggacatcggggtgccgcttctggctctgggatgctacagccaggtcaaccctctcaccctgacagccgctgtgcttatgctggttgcccattatgctattatcggccccgggctccaggccaaggcgacgcgcgaagcccagaaaagaaccgctgccggaattatgaagaatcccacagtggatggcatcgtcgctattgacctggatcctgtggtttacgacgccaaattcgagaagcaactggggcagatcatgctccttatcctgtgtacctctcagattctgctcatgcggacaacctgggccctgtgcgaatccatcacgcttgcgacaggaccgctgaccaccctctgggagggcagccccggcaaattttggaacacaaccattgctgtgtctatggccaatatcttccgcgggagctatctggctggagccggcctggccttctccctcatgaagtctcttgggggaggcagacgggggacaggagctcagggcgagacgctgggcgaaaagtggaaacgccaactgaaccagctcagcaagtccgagtttaatacctacaaaagaagcgggattatggaagtcgaccggtccgaggccaaggaaggactgaaaagaggcgagacaaccaagcacgcggtgtctcgcgggacagccaaacttcggtggttcgtggagagaaacctggttaaacctgaaggaaaggtcatcgatctcggctgtgggcgcggaggctggagctattactgcgctggcctgaaaaaggtgaccgaggtgaaagggtatacgaagggaggccccgggcatgaggaacctatccccatggccacctacggatggaatctggtcaaactccactccggcaaggacgtgtttttcatgcctccggaaaagtgtgatacacttctgtgcgacattggggagtctagccccaaccctaccatcgaggaaggacggacactgagagttctcaaaatggtggagccctggctgcgcggcaatcagttttgtattaagatccttaacccttacatgccctccgtcgtggaaaccctggagcagatgcaacggaaacacggcgggatgctcgttagaaatccgctgtctcgcaacagcacacatgagatgtattgggtgtcctgcggaaccggcaatattgtcagcgctgtgaacatgacgtctcggatgctgctcaacagattcacaatggcccaccgcaagcctacctacgaacgggatgttgacctgggggcgggaaccagacatgtggccgtcgagcccgaagtggctaatcttgatatcattggccagcgcatcgagaacatcaaaaatgaacacaagtccacatggcactatgacgaggataacccctacaagacgtgggcctatcatgggagctacgaggtgaaaccttctggatccgctagctctatggtcaatggcgttgtgagactgctcaccaagccctgggacgtgattcctatggtcacacagatcgccatgaccgatacaaccccgtttggccaacagcgggtgttcaaagaaaaggttgacacacgcacccccagagctaaacgggggacgacccagattatggaggtgacagccaagtggctgtggggatttctttccagaaacaagaaacctcggatctgtacccgcgaagagttcacaagaaaggtccggagcaatgcggccattggcgctgtgtttgttgacgaaaaccagtggaactccgccaaagaggctgtggaggatgaacgcttctgggacctggtccacagagagcgggaactccataagcaagggaaatgcgctacctgcgtgtataacatgatgggaaagcgcgagaagaaactgggcgaatttgggaaggccaaaggcagcagagcgatctggtacatgtggctgggagctcggttcctcgagttcgaggccctgggctttatgaatgaagatcactggttctctcgcgagaacagcctttccggggttgaaggagagggcctgcataagctcgggtacatcctgagagacatttctaaaatccccggaggcaatatgtatgccgatgacacggctgggtgggatacacggattaccgaggacgatcttcagaacgaagccaagatcacagacattatggagcctgaacacgctctgctcgccaccagcatctttaaactgacgtaccagaataaggtggtccgcgtgcagagacccgcgaagaacggcaccgtcatggatgtgatctcccggcgcgaccaaagaggatctggccaggttgggacatatggactgaacaccttcacaaatatggaggtgcagctcattcggcagatggaaagcgagggcatctttctgccgtccgagcttgaaacccctaacctggccgagagagtcctcgattggctggaaaaacacggggctgagcgccttaagcggatggccatttctggagacgactgtgtggtgaaacccatcgatgacagattcgctacagccctgaccgcgctcaatgatatgggcaaggttcgcaaagacattcctcaatgggaacccagcaaggggtggaacgattggcaacaggtgcctttttgctcccatcacttccatcagctgatcatgaaggacggccgggagatcgtcgtgccctgtagaaatcaagatgagctggttggacgcgcccgggtgagccagggcgctgggtggtctctcaaagaaacggcctgcctgggaaagtcctacgctcagatgtggcaacttatgtattttcacagacgcgacctgcggctcgccgctaacgccatttgtagcgcggtcccggtggattgggtccctacatctagaaccacctggtccatccacgcccatcaccagtggatgacaaccgaggacatgctgagcgtgtggaatcgcgtttggattgaagagaacccctggatggaagataaaacacatgtgtcctcttgggaggaggtcccctaccttggcaagcgggaagaccagtggtgcgggagcctgatcggactcacggctagagccacctgggccacaaatattcaggtggctatcaaccaagttcggagactgattggcaatgagaactatctggactacatgacctccatgaaacgcttcaagaatgaaagcgatcctgagggggccctctggtga

SEQ ID NO: 18616 - RNA, 9879 nt, synthetic construct
  misc_feature 1..9879: note = derived and/or modified CDS sequence (opt5) from DENV-1__KF955427__SS-prME
  source 1..9879: mol_type = other RNA
agcgtgacaatgctgctcatgctgcttcccacagctctggctttccacctcacgaccagaggaggggagcctcatatgatcgtcagcaagcaggaacgggggaaatctctgctttttaagacaagcgctggagttaacatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcacagaagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaagatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgcctggacaggggccacggaaatccagaccagcggaacaaccacaatttttgctggccatctgaaatggcgccttaagatggacaaactgaccctcaaggggacgtcctatgttatgtgcacaggcagcttcaaactggagaaggaagtggccgagacccagcacggaaccggcctggtccaagtgaagtacgaggggacagatgcgccgtgtaaaatccctttctctgctcaggacgaaaagggagttacccagaacggcagacttatcacagccaatcccattgtgacggataaagagaagcctgtcaacatcgaaaccgagccgccctttggggagtcctatattgtggtgggagccggcgaaaaagctctcaagctgagctggttcaagaaagggtctagcatcggcaagatgtttgaggccacagctcggggagccagacgcatggcgattctgggcgacaccgcctgggatttcgggtccatcggaggcgtttttacatctgtcgggaaactcgtgcatcaggtgttcggaaccgcttacggcgtcctgtttagcggggtgtcctggacgatgaagatcggcattggaatccttctgacctggctcggcctgaatagccggtctacatccctgagcatgacctgcattgccgttgggatggtgacactttacctcggagtcatggtgcaagctgactctggctgtgttatcaactggaaagggagagaactgaagtgcggatccggcattttcgtgaccaacgaggtccacacatggaccgaacagtataagtttcaggccgatagccctaaacgcctgtccgcggccatcgggaaggcttgggaggagggcgtgtgtggcattcggtctgccacgagactcgaaaatatcatgtggaaacagatcagcaacgagctgaatcatattcttctggaaaacgacatgaagttcacagttgtggtcggcgacgctaatgggatcctcgcccaaggcaaaaagatgattcgcccgcagcccatggagcacaaatactcctggaagtcttggggcaaggccaaaatcattggggctgatatccagaacaccacctttatcattgacggacctgatacacccgaatgccctgacaatcagcgggcgtggaacatctgggaggtggaggattatggcttcggcatttttaccacgaatatctggctgaagctgagagacagctacacacaaatgtgtgatcaccgccttatgtccgccgctattaaagacagcaaggccgtgcatgccgatatggggtattggatcgaatctgagaaaaacgaaacctggaagctcgctcgggcctccttcatcgaggtcaagacatgcacctggcccaaaagccacacactgtggtctaatggagttctggaatccgagatgattatcccgaagatttacggcgggcctatcagccagcataactatagacccggatacttcacccagacggcgggcccttggcacctcgggaaactggagcttgactttgatctgtgtgaaggaaccacagtggtggtcgacgagcactgcggcaatcgcggcccctctctccggaccacaaccgtgacggggaagattatccatgaatggtgctgtagaagctgcacactgcctcccctgcggttccgcggagaggatggctgttggtacgggatggagatcagaccggttaaagaaaaggaggaaaaccttgtgcggtccatggtcagcgctggatctggcgaggtggactcctttagcctcgggattctgtgcgcctccatcatgattgaagaggttatgagatctcgctggagccggaagatgctgatgaccggaacactcgccgtgttcctgcttctggtcatgggccaactcacctggaatgacctgatcagactgtgtattatggtgggcgctaacgcctccgatcgcatggggatgggaaccacatatcttgcgctgatggctacgtttaaaatgagacctatgttcgccgttggcctcctgtttcggcgcctcacctctagagaggtgctgcttctgacaatcgggctcagcctggtcgcctccgtggaactgcccaactctcttgaggaactgggagacggcctcgctatggggattatgatgctgaagctcctgaccgagttccagccccaccagctttggacaaccctgctcagcctgacgtttatcaaaacaaccctgtcccttgattacgcctggaagaccacagctatggccctgagcatcgtgtctctcttccctctgtgcctctccaccacaagccagaaaacgacctggctgccggtccttctgggatcttttggctgtaagcccctgacaatgttcctcattaccgaaaataagatctggggccggaaatcctggcctctgaacgaggggattatggcgatcggaattgttagcatccttctgtcttccctcctgaagaatgacgtgcccctccctgatcccctgatcgccggcgggattcttatcgcttgctatgtgattagcggatccagcgccgacctgtctctggagaaagctgccgaaatgagctgggagcaagaagccgagcattccggcacatctcacaacatcctcgtcgaagtgcaggatgacgggcctatgaagattaaagatgaggagcgcgacgataccctgacgatccttctgaaggctaccctcctggcggttagcggagtgtaccccatgtccatcccgggcacactctttgtctggtatttctggcagaaaaagaagcagagatctggcgtgctgtgggacaccccttctccccctaaagttgaacgggccgtgcttgatgacgggatttaccgcatcctgcaaagaggactgctcggccggtcccaggtcggggtgggagtcttccaggacggcgtgtttcatacaatgtggcacgttacccgcggggctgtgctgatgtatcagggaaagagacttgagccctcctgggccagcgtcaaaaaggatctgatttcctacggcggcgggtggcggttccaaggaagctggaatacaggcgaagaggtgcaggttatcgccgtggagccggggaaaaaccctaagaatgtccagacgacccccggaacatttaagacccctgaaggcgaggtgggggctattgccctcgacttcaaacccggaacctctggctcccccatcgtgaacagagaaggcaagattgttgggctgtacggaaatggcgtcgtgacaacgagcgggacctatgtgtctgcgatcgctcaagccaaagcctcccaggagggacctctcccggaaatcgaggatgaggtctttaagaaacgcaacctgacaattatggaccttcaccccggcagcgggaagacccggagatacctgcctgctatcgtgcgcgaagccattaagcggaaactgagaacactcatcctggcgcccacccgcgttgtggcttccgagatggccgaagcccttaagggcatgcctattcggtatcagacgacagctgtcaaatctgagcataccggaagagaaatcgtggatctgatgtgtcacgccaccttcacaatgcgcctcctgagccccgttcgggtgcctaattacaacatgatcattatggacgaggctcattttaccgatccggcctccatcgcggccagaggctatattagcacacgggtcgggatgggagaggctgccgctatcttcatgaccgccacgccccctggctctgtggaagcctttccccagtccaatgctgttattcaagacgaggaacgcgatatccctgagagaagctggaactctgggtacgactggatcacagatttccccggaaagaccgtgtggtttgtcccgagcattaaatccggcaatgacatcgcgaactgcctgcggaagaacgggaagcgcgtgattcagctctctagaaaaacattcgacaccgaatatcagaagacgaaaaataacgattgggactacgtggtcaccacagatatcagcgagatgggcgccaatttccgggctgacagagttattgatcctcgccggtgtcttaagcccgtgatcctgaaagacggacccgagagagtgattctggccggccctatgcccgtcaccgtggcctccgctgcccagcgccgggggagaatcggacgcaaccaaaataaggaaggcgatcagtacgtttatatggggcagcctctcaacaatgacgaggatcacgcgcattggacagaagctaagatgctgcttgacaacatcaataccccggagggaattatccccgccctgtttgagcctgaacgggagaaatctgccgctattgatggcgaatacagactccgcggggaggccagaaagacattcgtggaactgatgcggcgcggcgacctgcccgtctggctcagctataaagtggcgtccgagggatttcagtacagcgatagacggtggtgcttcgacggcgagcgcaacaatcaagttcttgaagagaacatggacgtggaaatctggaccaaggagggggaacgcaaaaagctgcggcctagatggctggatgcccgcacgtattctgaccccctcgctctgcgggagtttaaagagttcgccgctggaagacgctccattagcggcgatcttatcctggaaatcgggaagctcccgcagcacctgacactgcgggcccagaatgctctcgacaaccttgtcatgctgcacaattccgagcagggaggcaaggcctacagacatgcgatggaggaactgcctgataccattgaaaccctcatgctgcttgccctgatcgctgtgctcacaggcggggtcaccctgtttttcctgtctggaaaaggcctcgggaagacaagcattggacttctgtgcgtgacggcctcctctgctctgctctggatggccagcgttgagccccactggatcgccgcttccattatcctggagtttttccttatggtgctgctcatccctgaacccgaccggcaacgcacccctcaggataaccagctggcgtatgtggtcattggcctgctctttatgatccttacagttgccgctaacgagatggggctgctggaaaccaccaaaaaggacctcggaattggccatgtggccgccgagaatcaccaacacgctaccatgctggatgtggaccttagacccgccagcgcgtggacgctgtacgccgtcgctaccacagtgatcaccccgatgatgcggcatacaattgagaacaccacggccaatatctctctcacagctattgccaaccaggcggccatcctgatgggcctggataaagggtggcctatctccaagatggacattggagttcccctccttgctctgggctgttacagccaggtgaatcccctgaccctcacagccgctgtcctgatgcttgtggcccactatgctatcattgggcctggactgcaggccaaggcgacccgcgaagcccagaaaagaaccgctgccggcatcatgaagaacccgacagtcgatgggattgtggctatcgacctcgaccccgttgtgtacgatgccaaattcgagaagcagctgggacagatcatgctgctcattctttgcacgtctcagatcctgctgatgcggaccacatgggccctctgtgaatccattaccctggcgacaggccctcttaccacgctgtgggagggcagccccgggaaattttggaatacaaccatcgctgtctctatggccaacattttccgcggaagctatctcgctggcgccgggctggccttctccctgatgaagtctctcggaggcgggagacggggaaccggcgctcaaggcgaaacacttggggagaagtggaaacgccagctgaatcagctgagcaagtccgagtttaacacctacaaaagaagcggaatcatggaagtggaccggtccgaggccaaggaaggcctcaaaagaggggagacaacgaagcatgcggtttctcgcggaaccgccaagctgcggtggttcgtggaaagaaatcttgtcaaacctgagggcaaggtgatcgatctggggtgcggacgcggcggctggagctattactgtgctgggctcaaaaaggtgacagaggttaaaggatataccaagggcgggcccggacacgaggagcctattccgatggccacatacggctggaacctggtcaaactgcattccgggaaggacgtgtttttcatgccccctgaaaagtgcgataccctcctttgtgacatcggagagtctagccccaatcctacgattgaagagggccggaccctgagagtgctgaaaatggtcgagccctggctccgcggcaaccagttttgcatcaagattctgaatccgtacatgccttccgttgtggaaacacttgagcaaatgcagcggaaacacgggggaatgctggtgagaaaccccctctctcgcaatagcacccacgaaatgtattgggtctcctgtggcacagggaacatcgtgagcgctgttaacatgacctctcggatgctgctgaatagattcacaatggcccatcgcaagcccacctacgagcgggatgtggacctcggagcgggcacgagacacgtcgccgtggagcctgaagttgctaacctggatattatcgggcagcgcatcgagaatattaaaaacgaacataagtccacatggcactatgacgaggataatccctacaagacctgggcctatcacggaagctacgaagtgaaaccttctggctccgctagctctatggtcaacggcgtggtgagacttctgaccaagccgtgggacgtcatccccatggttacacaaattgccatgacggacaccacaccttttgggcagcagcgggtgttcaaagagaaggtggatacccgcacacccagagctaaacggggaaccacacagatcatggaggtcaccgccaagtggctctggggctttctgtccagaaataagaaacctcggatttgcacgcgcgaagagttcaccagaaaggtgcggagcaacgcggccatcggggctgtttttgtggacgaaaatcaatggaactccgccaaagaggctgtcgaagatgagcgcttctgggaccttgtgcatagagagcgggaactgcacaagcagggaaaatgtgccacatgcgtttataatatgatgggcaagcgcgagaagaaactcggggaatttggcaaggccaaaggaagcagagcgatctggtacatgtggctgggcgctcggttcctggagttcgaagccctcgggtttatgaacgaggatcattggttctctcgcgagaatagcctgtccggagtggaaggcgaggggcttcacaagctgggatacattctcagagacatctctaaaattcccggcgggaacatgtatgccgatgacaccgctggctgggatacacggatcaccgaagacgatctgcagaatgaggccaagattacggagatcatggaaccggagcatgcccttctggccacaagcatctttaaactcacctaccagaacaaggtcgtgcgcgttcaaagacctgcgaagaacggaacagtgatggacgtcatttcccggcgcgatcagagaggctctggacaggtgggaacctatggcctgaatacgttcaccaacatggaagtccagctgatccggcaaatggagagcgaagggatttttctcccctccgagctggagacacctaatcttgccgaaagagtgctggactggctcgagaaacacggagctgaacgcctgaagcggatggccatctctggcgacgattgcgttgtgaaacccattgacgatagattcgctaccgcccttacagcgctgaacgacatggggaaggtccgcaaagatatccctcagtgggagcccagcaagggctggaatgactggcaacaggtgccgttttgttcccaccatttccaccaactcatcatgaaggatggacgggaaattgtggttccttgcagaaaccaggacgagctggtgggccgcgcccgggtcagccagggggctggatggtctctgagagagaccgcctgtctcggcaaatcctacgctcaaatgtggcagctgatgtattttcatcgccgggatcttagactggccgctaatgccatctgcagcgcggtgcccgttgactgggtgcccacatctcgcaccacgtggtccattcacgcccaccatcagtggatgacaaccgaagatatgctcagcgtctggaaccgggtgtggatcgaggaaaatccttggatggaggacaagacccacgtctcctcttgggaagaggtgccgtacctggggaaaagagaggaccagtggtgtggaagccttattggcctgacagctcgggccacctgggccacaaacatccaagttgctattaatcaggtgagacgcctcatcgggaacgaaaattatctggattacatgacgtccatgaagcggttcaaaaacgagagcgaccccgaaggcgccctgtggtga

SEQ ID NO: 18617 - RNA, 9879 nt, synthetic construct
  misc_feature 1..9879: note = derived and/or modified CDS sequence (opt5) from DENV-1__GQ868513__SS-prME
  source 1..9879: mol_type = other RNA
agcgtgaccatgctgctcatgctgcttcccaccgctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccgcagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgccgaccgccctgacaggggccacggaaatccagaccagcggaacaaccacaatttttgctggccaccttaaatgccgcctgaagatggacaaactcaccctgaaggggacgtcctatgttatgtgtacaggcagcttcaaactggagaaggaagtggccgagacccagcatggaaccgtccttgtgcaagttaagtacgagggcacagatgcgccttgcaaaatccccttctctacccaggacgaaaagggggtgacacagaacggaagactcatcacggctaatcctattgtcaccgataaagagaagcccgtgaacatcgaaacagagcccccttttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcaccaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcatacctggacggaacagtataagtttcaggctgatagcccgaaacgcctctccgccgcgatcggcaaggcctgggaggagggggtttgcggcattcggtctgctacaagactggaaaatatcatgtggaaacagatcagcaacgagcttaatcacattctgctcgaaaacgacatgaagttcaccgtggtcgtgggagacgccaatggcatcctggctcaagggaaaaagatgattcgcccccagcctatggagcataaatactcctggaagtcttggggaaaggccaaaatcattggcgccgatatccagaacaccacatttatcattgacgggcccgatacccctgaatgtcccgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccacgccgatatgggctattggatcgaatctgagaaaaacgaaacatggaagctggcccgggcttccttcatcgaggttaagacctgtacatggccgaaaagccataccctgtggtctaatggggtgctcgaatccgagatgattatccctaagatttacggaggccccatcagccagcacaactatagacctgggtacttcacgcagaccgccggaccctggcatctgggcaaacttgagctggactttgatctctgcgaagggacaaccgtggtcgtggacgagcactgcggaaatcgcggcccttctctgcggacaaccacggttacaggcaagattatccacgaatggtgttgcagaagctgtaccctgcccccgcttcggttccgcggggaggatggatgctggtacggcatggagatcagacctgtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacccatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagcctcatcagctgtggatcaccctcctgagcctgacgtttatcaaaacaaccctttccctggattacgcttggaagaccacagccatggctctcagcattgtctctctgttcccgctctgtctgtccaccacaagccagaaaacgacctggcttcccgttctgctggggtcttttggatgcaagcctctcacaatgttcctgatcaccgaaaataagatttggggccggaaatcctggccccttaacgagggcatcatggccattgggatcgtgagcatcctgctctcttccctgctcaagaatgacgtgcctctggcgggaccccttattgccggcgggatgctgatcgcttgttatgtcattagcggatccagcgccgatctgtctctcgagaaagctgccgaagtgagctgggagcaagaagccgagcactccggcacatctcataacatcctggttgaagtgcaggacgatgggaccatgaagattaaagacgaggagcgcgatgacacgcttaccatcctgctcaaggctacactgctcgcggtcagcggagtgtaccctatgtccatccccgccaccctgtttgtttggtatttctggcagaaaaagaagcagagatctggcgtgctttgggatacaccgagccctcccgaagtcgagcgggctgtgctggacgatggcatttaccgcatcctgcaaagagggctcctgggacggtcccaggtcggcgtgggggttttccaggacggagtgtttcacaccatgtggcatgtcacacgcggcgccgtgcttatgtatcaggggaaaagactggaaccttcttgggccagcgttaagaaagacctcatttcctacggaggcggctggcggttccaagggagctggaatacgggagaggaggtgcaggtcatcgctgtggaacccggcaagaacccgaaaaatgtgcagaccatgcctgggacatttaagacccccgagggagaagttggcgccattgcgctggatttcaagcctgggacctctggatcccccatcgtcaacagagagggcaaaattgtgggcctctacgggaatggagtggtcacaacgagcggcacctatgtgtctgctatcgcccaagccaaggcttcccaggaagggcccctgcctgagatcgaggacgaagtttttaaaaagcgcaaccttacaattatggatctgcacccgggaagcggcaaaacccggagatacctgcccgccatggtgcgcgaggcgatcaagcggaagctcagaacactgattcttgctcctacccgcgtcgtggcctccgaaatggccgaggctctgaaagggatgcccatccggtatcagacgacagccgttaagtctgaacacaccggcagagagattgtggacctcatgtgccatgctaccttcacaatgcgcctgctgagccctgtccgggtgcccaattacaacatgatcatcatggatgaggcccactttaccgaccctgcgtccattgccgctagaggatatatcagcacacgggttggcatgggggaagccgctgccattttcatgaccgccacgccgcccggatctgtggaggcttttcctcagtccaatgcggtcatccaagatgaagaacgcgacattcccgaaagaagctggaactctggctacgattggatcacagacttccctgggaaaaccgtgtggtttgtgcccagcatcaagtccggaaatgatattgccaactgtctccggaaaaacggcaagcgcgtcatccagctttctagaaagacattcgacaccgagtatcagaaaacgaagaataacgactgggattacgttgtgaccacagacattagcgagatgggggctaatttccgggccgatagagtgatcgacccgcgccggtgcctgaaacctgtcattctgaaggatggccccgaaagagtgatcctcgccggacccatgcctgttaccgtggcttccgccgcgcagcgccggggcagaattgggcgcaaccaaaataaagagggagaccagtacgtctatatgggccagcccctgaacaatgatgaagaccatgctcactggacagaggccaagatgcttctggataacatcaatacccctgaggggatcattccggccctctttgaacccgagcgggaaaagtctgctgccatcgacggagagtacagactgcgcggcgaagcgagaaaaacattcgtggagctgatgcggcgcggggatctccctgtttggcttagctataaggtggcctccgagggctttcagtacagcgacagacggtggtgcttcgatggagaacgcaacaatcaagtcctggaggaaaacatggacgtggagatttggaccaaagaaggcgagagaaagaaactgcggcccagatggctcgacgctcgcacgtattctgatcctctggcccttcgggagtttaaggagttcgctgccgggagacgctccgtcagcggagacctgatcctcgagattggcaaactgccccagcatctgacactccgggctcagaatgcccttgataacctggtgatgctgcacaattccgaacaagggggaaaggcgtacagacacgccatggaggaactcccggacaccatcgagaccctgatgcttctggctctcatcgccgttctgacaggcggcgtgaccctgtttttcctctctgggaagggacttggcaaaacaagcattgggctgctgtgtgtgacggcttcctctgccctcctgtggatggccagcgtcgagcctcattggatcgctgcgtccattatccttgaatttttcctgatggttctcctgattcccgagcctgatcggcaacgcacaccccaggacaaccagctggcctatgtggtgatcggactcctttttatgatcctgacagtcgctgccaacgaaatgggcctgctcgagaccacaaagaaagatctggggattggacacgtggccgctgagaatcatcaacacgccaccatgcttgacgttgatctgagacctgcgagcgcctggacgctctacgctgtggccaccacagtcatcacccccatgatgcggcacacaattgaaaacaccacggctaatatctctctgacagccattgcgaaccaggccgctatcctgatgggcctcgacaagggctggccgatttccaaaatggatatcggggtgcctcttctggccctgggatgctacagccaggtcaatcccctcaccctgacagctgccgtgcttatgctggttgctcattatgccatcattggccccgggctccaggcgaaggccacccgcgaggctcaaaagagaaccgccgctggaatcatgaaaaaccctacagtggacggcattgtcgccatcgatctggacccggtggtttacgacgccaagttcgaaaaacagctggggcagattatgctccttatcctgtgtacgtctcagatcctgctcatgcggaccacatgggcgctgtgcgagtccattacccttgctacaggacccctgaccacgctctgggaaggcagccctggcaagttttggaatacaaccatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacctacaagagaagcgggatcatggaggtcgatcggtccgaagcgaaagagggactgaagagaggcgaaacaacgaaacacgccgtgtctcgcgggaccgctaaacttcggtggttcgtggagagaaatctggttaagcccgagggaaaagtcattgacctcggctgtgggcgcggaggctggagctattactgcgccggcctgaagaaagtgacagaagtgaaggggtataccaaaggaggccctgggcatgaggaacccatccctatggctacatacggatggaacctggtcaagctccactccggcaaagatgtgtttttcatgccgcccgagaagtgtgacacccttctgtgcgatatcggggaatctagccctaatcccacgattgaggagggacggaccctgagagttctcaagatggtggaaccttggctgcgcggcaaccagttttgtatcaaaattcttaatccctacatgccgtccgtcgtggagacactggaacaaatgcagcggaagcatggcgggatgctcgttagaaaccctctgtctcgcaatagcacccacgagatgtattgggtgtcctgcggaacaggcaacatcgtcagcgccgtgaacatgacctctcggatgctgctcaatagattcacaatggcgcaccgcaaacccacctacgagcgggacgttgatctgggggccggaacgagacatgtggctgtcgaacccgaggtggccaaccttgacattatcggccagcgcattgaaaatatcaagaacgagcacaaatccacatggcattatgatgaagacaatccttacaagacctgggcttatcacgggagctacgaggtgaagccctctggatccgccagctctatggtcaacggcgttgtgagactgctcaccaaaccttgggatgtgatcccgatggtcacacaaattgctatgacggacaccacaccctttggccagcagcgggtgttcaaggagaaagttgacacccgcacacctagagccaagcgggggaccacacagatcatggaagtgaccgcgaaatggctgtggggatttctttccagaaataagaagccccggatttgtacgcgcgaggagttcaccagaaaagtccggagcaacgccgctatcggcgccgtgtttgttgatgagaatcaatggaactccgctaaggaagccgtggaggacgagcgcttctgggatctggtccacagagaacgggagctccataaacaggggaagtgcgccacatgcgtgtataatatgatgggaaaacgcgaaaagaagctgggcgagtttgggaaagcgaagggcagcagagctatttggtacatgtggctgggagcccggttcctcgagttcgaggccctgggctttatgaacgaggaccactggttctctcgcgaaaatagcctttccggggttgagggagaaggcctgcataaactcgggtacatcctgagagatatctctaagattcctggaggcaacatgtatgctgacgataccgccgggtgggacacacggatcaccgaggatgaccttcagaatgaggctaaaattacggaaatcatggagcccgaacacgccctgctcgcgacaagcatttttaagctgacctaccagaacaaagtggtccgcgtgcaaagaccggccaagaacggcacagtcatggatgtgatctcccggcgcgaccagagaggatctggccaggttgggacctatggactgaatacgttcaccaacatggaggtgcagctcatccggcaaatggaaagcgagggcatttttctgccttccgagcttgaaacacccaatctggctgagagagtcctcgattggctggaaaagcatggggccgagcgccttaaacggatggctatctctggagacgactgtgtggtgaagcctattgatgacagattcgccaccgcgctgacagccctcaacgatatgggcaaagttcgcaaggacatcccccagtgggaacctagcaaagggtggaatgattggcaacaggtgcccttttgctcccaccacttccatcaactgattatgaaggacggccgggagatcgtcgtgccgtgtagaaaccaggatgagctggttggacgcgctcgggtgagccagggcgccgggtggtctctcagagaaaccgcttgcctgggaaagtcctacgcccaaatgtggcagcttatgtattttcaccgccgggacctgagactcgctgccaatgcgatctgtagcgccgtccctgtggattgggtccccacatctcgcaccacgtggtccattcatgctcaccaccagtggatgacaaccgaggacatgctgagcgtgtggaaccgggtttggatcgaagagaatccctggatggaagataaaacccatgtgtcctcttgggaggaggtcccttaccttggcaagagagaagaccagtggtgcgggagcctgattggactcacagcccgggccacctgggctacaaacatccaagtggccattaatcaggttagacgcctgatcggcaacgagaattatctggactacatgacgtccatgaaacggttcaagaacgaaagcgatccggagggggcgctctggtga

SEQ ID NO: 18618 - RNA, 9879 nt, synthetic construct
  misc_feature 1..9879: note = derived and/or modified CDS sequence (opt5) from DENV-1__GU131973__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagatgagaacgctcattctggcgcccacacgcgtggttgcttccgaaatggccgaggcccttaaagggatgcctatccggtatcagaccaccgctgtgaagtctgaacatacaggcagagagattgtcgacctgatgtgccacgccaccttcacaatgcgcctcctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctgcggaaaaacggcaagcgcgttatccagctctctagaaagacgttcgacaccgagtatcagaaaacaaagaataacgactgggattacgtggtgaccacagacattagcgagatgggggccaatttccgggctgatagagtcatcgacccccgccggtgccttaaaccggtgattctgaaggatggccctgaaagagttatcctggccggacccatgcccgtgaccgtcgcctccgctgcccagcgccggggcagaattgggcgcaaccaaaataaagagggagaccagtacgtgtatatgggccagcctctcaacaatgatgaagaccacgcgcattggacagaggctaagatgctgcttgataacatcaatacccccgaggggatcattcctgccctgtttgaaccggagcgggaaaagtctgccgctatcgacggagagtacagactccgcggcgaagccagaaaaacgttcgttgagctgatgcggcgcggggatctgcccgtgtggctcagctataaggtcgcgtccgagggctttcagtacagcgacagacggtggtgcttcgatggagaacgcaacaatcaagtgcttgaggaaaacatggacgtcgagatttggacaaaagaaggcgagagaaagaaactgcggcctagatggctggacgcccgcacctattctgatcccctcgctctgcgggagtttaaggaattcgccgctgggagacgctccgtgagcggagaccttatcctggagattggcaaactccctcagcacctgaccctgcgggcccagaatgctctcgataaccttgttatgctgcacaattccgaacaggggggaaaggcctacagacatgcgatggaggaactgcccgacacaatcgagaccctcatgctgcttgccctgatcgctgtgctcacaggcggcgtgacgctgtttttcctgtctgggaagggactcggcaaaaccagcattgggcttctgtgtgtcacagcctcctctgctctgctctggatggccagcgttgagccgcactggatcgccgcttccattatcctggaatttttccttatggtgctgctcattcctgagcccgatcggcaacgcacccctcaggacaaccagctggcgtatgtggtcatcggactgctctttatgatccttacagtggccgctaacgaaatgggcctgctggagaccacgaagaaagatctcgggattggacatgttgccgccgagaatcaccaacacgctaccatgctggacgtggatcttagacccgccagcgcgtggacactgtacgccgtcgctaccacagtgatcacccctatgatgcggcatacgattgaaaacacaaccgccaatatctctctcacagctattgccaaccaggcggccatcctgatgggcctggacaagggctggcccatttccaaaatggatatcggggtcccgctccttgctctgggatgctacagccaggtgaatcctctgaccctcaccgccgctgttctgatgcttgtggcccactatgctatcattggccccgggctgcaggccaaggcgacacgcgaggcccaaaagagaacggctgccggaatcatgaaaaaccccaccgtcgacggcattgtggctatcgatctcgaccctgttgtgtacgacgccaagttcgaaaaacagctggggcagattatgctgctcatcctttgtacatctcagatcctgctgatgcggaccacatgggccctctgcgagtccattaccctggcgacgggaccgcttacaaccctgtgggaaggcagccccggcaagttttggaataccacaatcgctgtctctatggccaacattttccgcgggagctatctcgctggagccggcctggccttctccctgatgaaatctctcgggggaggcagacgggggaccggagctcaaggcgagacacttggcgagaagtggaagcgccagctgaatcagctgagcaaatccgaatttaacacgtacaagagaagcgggatcatggaggtggatcggtccgaagccaaagagggactcaagagaggcgaaaccacaaaacatgcggtgtctcgcgggaccgccaagctgcggtggttcgttgagagaaatcttgtcaagcctgagggaaaagtgattgacctgggctgtgggcgcggaggctggagctattactgcgctggcctcaagaaagtgacagaagtcaaggggtataccaaaggaggccccgggcacgaggaacctatccccatggccacgtacggatggaacctggttaagctgcattccggcaaagatgtgtttttcatgcctccggagaagtgtgacaccctcctttgcgatatcggggaatctagccccaatcctacaattgaggagggacggaccctgagagtgctgaagatggtcgaaccctggctccgcggcaaccagttttgtatcaaaattctgaatccttacatgccctccgtggttgaggctcttgaacaaatgcagcggaagcacggcgggatgctggtgagaaacccgctctctcgcaatagcacacacgagatgtattgggtctcctgcggaaccggcaacatcgtgagcgccgttaacatgacatctcggatgctgctgaatagattcaccatggcgcatcgcaaacctacgtacgagcgggacgtggatctcggggccggaacaagacacgtcgctgtggaacccgaggtggccaacctggacattatcggccagcgcattgaaaatatcaagaacgagcataaatccacctggcactatgatgaagacaatccctacaagacctgggcttatcacgggagctacgaggtcaagccttctggatccgccagctctatggttaacggcgtggtgagacttctgacaaaaccctgggatgtcatccctatggtgacgcaaattgctatgaccgacacaaccccgtttggccagcagcgggttttcaaggagaaagtggacacacgcacccccagagccaagcgggggacaacccagatcatggaagtcacggcgaaatggctctggggatttctgtccagaaataagaagcctcggatttgtacccgcgaggaattcacaagaaaagtgcggagcaacgccgctatcggcgccgtttttgtggatgagaatcaatggaactccgctaaggaagccgtcgaggacgagcgcttctgggatcttgtgcatagagaacgggagctgcacaaacaggggaagtgcgccacctgcgtttataatatgatgggaaaacgcgaaaagaagctcggcgagtttgggaaagcgaagggcagcagagctatttggtacatgtggctgggagcccggttcctggaattcgaggccctcggctttatgaacgaggaccattggttctctcgcgaaaatagcctgtccggggtggagggagaaggccttcacaaactggggtacatcctcagagatatctctaagattcccggaggcaacatgtatgctgacgatacagccgggtgggacacccggatcacggaggatgacctgcagaatgaggctaaaattacagaaatcatggagcctgaacatgcccttctggcgaccagcatttttaagctcacataccagaacaaagtcgtgcgcgtccaaagacccgccaagaacggcaccgtgatggatgttatctcccggcgcgaccagagaggatctggccaggtggggacgtatggactgaataccttcacaaacatggaggtccagctgatccggcaaatggaaagcgagggcatttttctcccgtccgagctggaaacccctaatcttgctgagagagtgctggattggctcgaaaagcacggggccgagcgcctgaaacggatggctatctctggagacgactgtgtggttaagcccattgatgacagattcgccacagcgcttaccgccctgaacgatatgggcaaagtgcgcaaggacatccctcagtgggaacccagcaaagggtggaatgattggcagcaggtccctttttgctcccaccatttccaccaactcattatgaaggacggccgggagatcgtggttccctgtagaaaccaggatgagctggtgggacgcgctcgggtcagccagggcgccgggtggtctctgagagaaacagcttgcctcggaaagtcctacgcccaaatgtggcagctgatgtattttcatcgccgggaccttagactggctgccaatgcgatctgtagcgccgtgccggtcgattgggtgcctacctctcgcacgacatggtccattcacgctcaccatcagtggatgaccaccgaggacatgctcagcgtttggaaccgggtgtggatcgaagagaatccctggatggaagataaaacacacgtctcctcttgggaggaggtgccctacctgggcaagagagaagaccagtggtgcgggagccttattggactgaccgcccgggccacatgggctacgaacatccaagttgccattaatcaggtgagacgcctcatcggcaacgagaattatctggactacatgacctccatgaaacggttcaagaacgaaagcgatcctgagggggcgctgtggtga

SEQ ID NO: 18619 - RNA, 9879 nt, synthetic construct
  misc_feature 1..9879: note = derived and/or modified CDS sequence (opt5) from DENV-1__GQ868517__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttcctcacccaggacgaaaagggggtgacacagaacggaagactgatcacggctaatcccattgtcaccgataaagagaagcctgtgaacatcgaaacagagcccccctttggcgagtcttatattgtggttggggccggagaaaaagccctgaagctctcctggttcaagaaaggcagctctatcgggaagatgtttgaggctaccgcccggggcgctagacgcatggccattctgggagacacagcgtgggatttcggcagcatcgggggagtctttacctccgtgggcaaacttgtgcatcaggtcttcgggacggcctacggagtgctgttttctggcgttagctggaccatgaagatcgggattggcatcctcctgacatggctgggacttaattcccggagcacctctctctccatgacatgtattgctgtgggcatggtcaccctgtacctgggggtgatggttcaagccgacagcggatgcgtgatcaactggaaaggcagagaactcaagtgtgggtctggaattttcgtcacaaacgaggtgcacacctggacggaacagtataagtttcaggctgattcccctaaacgcctgagcgccgcgatcggcaaggcctgggaggagggggtttgcggcattcggtccgctacaagacttgaaaatatcatgtggaaacagatctctaacgagctgaatcatattctcctggaaaacgacatgaagttcaccgtggtcgtgggagacgccaatggcatcctggctcaagggaaaaagatgattcgcccgcagcccatggagcacaaatacagctggaagtcctggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggcttaagctcagagactcttacacccaaatgtgcgatcaccgcctgatgagcgcggccattaaagactccaaggctgtccatgccgatatgggctattggatcgaaagcgagaaaaacgaaacatggaagctggcccgggcttctttcatcgaggttaagacctgtacatggcccaaatcccacaccctctggagcaatggggtgctggaatctgagatgattatcccgaagatttacggaggccctatctcccagcataactatagacccgggtacttcacgcagaccgccggaccttggcaccttggcaaactggagctcgactttgatctgtgcgaagggacaaccgtggtcgtggacgagcactgcggaaatcgcggccccagcctgcggacaaccacggttacaggcaagattatccatgaatggtgttgcagatcttgtacccttcctcccctccggttccgcggggaggatggatgctggtacggcatggagatcagaccggtgaaagaaaaggaggaaaacctggtccggagcatggtgtccgcggggagcggagaggttgactctttttccctgggcattctctgtgctagcatcatgattgaagaggtgatgagatcccgctggtctcggaagatgctgatgacagggacccttgccgtcttcctgctcctgatcatgggacaactgacctggaatgaccttattagactgtgcatcatggtgggcgccaacgctagcgatcgcatgggcatggggacaacgtatctcgccctgatggcgacctttaaaatgagacctatgttcgctgttggactcctgtttcggcgccttacatccagagaggtgctgctcctgaccattggcctgtctcttgtcgccagcgtggaactgcccaactccctcgaggaactgggggacggactcgccatgggcatcatgatgctgaagcttctgacagagttccagccccaccagctctggaccacgctgctgtctcttacatttatcaaaaccaccctgagcctcgattacgcttggaagacaaccgccatggtgctgtccattgtcagcctcttccctctgtgtctttctacaacgtcccagaaaaccacatggctgccggttctgctcgggagctttggatgcaagcccctgaccatgttccttatcacagaaaataagatttggggccggaaatcttggcctctgaacgagggcatcatggctattgggatcgtgtccatcctcctgagctctctcctgaagaatgacgtgccccttgccggacctctgattgcgggcgggatgctgatcgcctgttatgtcatttccggaagctccgctgatctcagcctggagaaagccgctgaagtgtcttgggagcaagaagccgagcatagcggcacctcccacaacatccttgttgaagtgcaggacgatgggacgatgaagattaaagacgaggagcgcgatgacaccctgacaatcctcctgaaggccaccctcctggctgtctctggagtgtaccccatgagcatccctgcgacactttttgtttggtatttctggcagaaaaagaagcagagatccggcgtgctgtgggataccccctctccgcctgaagtcgagcgggccgtgctggacgatggcatttaccgcatcctccaaagagggctgcttggacggagccaggtcggcgtgggggttttccaggacggagtgtttcatacaatgtggcacgtcacgcgcggcgctgtgctgatgtatcaggggaaaagactcgaaccctcctgggcctctgttaagaaagacctgattagctacggaggcggctggcggttccaagggtcctggaataccggagaggaggtgcaggtcatcgccgtggaacctggcaagaaccccaaaaatgtgcagacaaccccggggacctttaagacacctgagggagaagttggcgctattgccctcgatttcaagcccgggacgagcggatctcctatcgtcaacagagagggcaaaattgtgggcctgtacgggaatggagtggtcaccacatccggcacctatgtgagcgcgatcgctcaagccaaggcctctcaggaagggccccttcccgagatcgaggacgaagtttttaaaaagcgcaacctgacaattatggatctgcaccctggatccggcaaaacccggagatacctcccggctatcgtgcgcgaggccattaagcggaagctgagaacgcttatcctggcgcccacacgcgtcgtggctagcgaaatggccgaggccctcaaagggatgcctattcggtatcagaccaccgctgttaagtccgaacatacaggcagagagatcgtggacctgatgtgccacgccaccttcacaatgcgcctgctctctcccgtccgggtgcctaattacaacatgatcattatggatgaggctcattttaccgaccccgccagcatcgcggccagaggatatatttccacgcgggttggcatgggggaagctgccgctatcttcatgacagccacccctccgggaagcgtggaggcctttccccagtctaatgctgtcattcaagatgaagagcgcgacatccctgaaagatcctggaacagcggctacgattggatcacagacttccccgggaaaaccgtgtggtttgtgccttctattaagagcggaaatgatatcgcgaactgtcttcggaaaaacggcaagcgcgtcattcagctgtccagaaagacgttcgacaccgagtatcagaaaacaaagaataacgactgggattacgttgtgaccacagacatctctgagatgggggccaatttccgggctgatagagtgattgacccccgccggtgcctgaaaccggtcatcctcaaggatggccctgaaagagtgattctggccggacccatgcccgttaccgtggccagcgctgcccagcgccggggcagaatcgggcgcaaccaaaataaagagggagaccagtacgtctatatgggccagcctcttaacaatgatgaagaccacgcgcattggacagaggctaagatgctgctcgataacatcaatacccccgaggggattatccctgccctgtttgaaccggagcgggaaaagtccgccgctattgacggagagtacagactgcgcggcgaagccagaaaaacgttcgtggagctcatgcggcgcggggatcttcccgtttggctgtcttataaggtggcgagcgagggctttcagtactccgacagacggtggtgcttcgatggagaacgcaacaatcaagtcctggaggaaaacatggacgtggagatctggacaaaagaaggcgagagaaagaaactccggcctagatggctggacgcccgcacctatagcgatccccttgctctgcgggagtttaaggaattcgccgctgggagacgctctgtctccggagacctcattctggagatcggcaaactgcctcagcacctcacccttcgggcccagaatgctctggataacctggtgatgctccacaatagcgaacaggggggaaaggcctacagacatgcgatggaggaactgcccgacacaatcgagacccttatgctgctcgccctgattgctgttctgacaggcggcgtgacgctctttttcctttccgggaagggactgggcaaaacctctatcgggctgctctgtgtgacagccagctccgctctgctttggatggcctctgtcgagccgcactggattgccgctagcatcattctggaatttttcctcatggttctgctgatccctgagcccgatcggcaacgcacccctcaggacaaccagctcgcgtatgtggtgatcggacttctgtttatgattctgacagtcgccgctaacgaaatgggcctcctggagaccacgaagaaagatcttgggatcggacatgtggccgccgagaatcaccaacacgctaccatgctggacgttgatctcagacccgcctccgcgtggacactgtacgccgtggctaccacagtcattacccctatgatgcggcatacgatcgaaaacacaaccgccaatattagcctgacagctatcgccaaccaggcggccattctcatgggccttgacaagggctggcccatctctaaaatggatatcggggtgccgctgctggctctcggatgctactcccaggtcaatcctctgacccttaccgccgctgtgctgatgctcgttgcccactatgctattatcggccccgggctgcaggccaaggcgacacgcgaggcccaaaagagaacggctgccggaattatgaaaaaccccaccgtggacggcatcgtcgctattgatctggaccctgtggtttacgacgccaagttcgaaaaacagctcgggcagatcatgcttctgatcctgtgtacaagccagattctcctgatgcggaccacatgggccctttgcgagtctatcaccctggcgacgggaccgctcacaaccctgtgggaaggctcccccggcaagttttggaataccacaattgctgtgagcatggccaacatcttccgcgggtcttatctggctggagccggcctcgccttcagccttatgaaatccctggggggaggcagacgggggaccggagctcaaggcgagacactgggcgagaagtggaagcgccagctcaatcagctgtctaaaagcgaatttaacacgtacaagagatccgggattatggaggtcgatcggagcgaagccaaagagggacttaagagaggcgaaaccacaaaacatgcggtgtcccgcgggaccgccaagctgcggtggttcgtggagagaaatctcgttaagcctgagggaaaagtcatcgacctgggctgtgggcgcggaggctggtcttattactgcgctggcctgaagaaagtgacagaagtgaaggggtataccaaaggaggccccgggcacgaggaacctatccccatggccacgtacggatggaacctcgtcaagcttcatagcggcaaagatgtttttttcatgcctccggagaagtgtgacaccctgctgtgcgatattggggaatcctctcccaatcctacaatcgaggagggacggaccctcagagtgctgaagatggtggaaccctggcttcgcggcaaccagttttgtattaaaatcctgaatccttacatgcccagcgtcgtggagacactcgaacaaatgcagcggaagcacggcgggatgctggttagaaacccgctgtcccgcaattctacccacgagatgtattgggtgagctgcggaacaggcaacattgtctccgctgtgaacatgaccagccggatgctcctgaatagattcacgatggcccatcgcaaacctacatttgagcgggacgttgatcttggggcgggaaccagacacgtggccgtcgaacccgaggtggctaacctggacatcattggccagcgcatcgaaaatatcaagaacgagcataaatctacctggcactacgatgaagacaatccctataagacatgggcctaccacgggtcctatgaggtgaagcctagcggatctgcttccagcatggtcaacggcgttgtgagactcctgacgaaaccctgggatgtgattcctatggtcacccaaatcgccatgacagacaccacaccgttcggccagcagcgggtgtttaaggagaaagttgacacccgcacacccagagctaagcgggggaccacgcagattatggaagtgaccgccaaatggctttggggattcctgtctagaaataagaagcctcggatctgtacacgcgaggaatttaccagaaaagtccggtccaacgcggccattggcgctgtgttcgttgatgagaatcaatggaacagcgccaaggaagctgtggaggacgagcgcttttgggatctcgtccatagagaacgggagctgcacaaacaggggaagtgcgccacatgcgtgtacaatatgatgggaaaacgcgaaaagaagctgggcgagttcgggaaagccaagggctccagagcgatctggtatatgtggctcggagctcggttcctggaatttgaggcccttggcttcatgaacgaggaccattggtttagccgcgaaaattctctgagcggggttgagggagaaggcctccacaaactggggtacatccttagagatatttccaagatccccggaggcaacatgtacgccgacgataccgctgggtgggacacgcggattacagaggatgacctgcagaatgaggccaaaatcaccgatattatggaacctgagcatgctctcctggccacatctatcttcaagctgacctatcagaacaaagtggtccgcgtgcaaagacccgcgaagaacggcacggtcatggacgtgatcagccggcgcgatcagagaggatccggccaggttgggacctacggactcaatacatttaccaacatggaagtgcagctgattcggcaaatggagtctgaaggcatcttccttccgagcgagctggagacacctaatctcgccgaaagagtcctggactggcttgagaagcacggggctgaacgcctgaaacggatggccatttccggagacgattgtgtggtgaagcccatcgacgatagatttgctaccgccctcacagcgctgaacgacatgggcaaagttcgcaaggatattcctcagtgggagccctctaaagggtggaatgactggcagcaggtgcctttctgcagccaccattttcaccaactgatcatgaaggatggccgggaaatcgtcgtgccctgtagaaaccaggacgagctcgttggacgcgcccgggtgtcccagggcgctgggtggagcctgagagagaccgcctgccttggaaagtcttatgctcaaatgtggcagctgatgtacttccatcgccgggatctcagactggccgctaatgccatttgttccgcggtcccggtggactgggtccctacgagccgcacaacctggtctatccacgcccaccatcagtggatgaccacagaagatatgctttccgtgtggaaccgggtttggattgaggaaaatccctggatggaggacaaaacccacgtgagctcctgggaagaggtcccctatctgggcaagagagaggaccagtggtgcgggtctctcatcggactgacagctcgggccacgtgggccaccaacattcaagtggctatcaatcaggttagacgcctgattggcaacgaaaattacctcgattatatgacaagcatgaaacggtttaagaacgagtccgaccctgaaggggccctgtggtga

SEQ ID NO: 18620 - RNA, 9879 nt, synthetic construct
  misc_feature 1..9879: note = derived and/or modified CDS sequence (opt5) from DENV-1__GU131976__SS-prME
  source 1..9879: mol_type = other RNA
agcgtgaccatgctgctgatgctgcttcccacagccctggctttccacctcacgaccagaggcggggagcctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccctcatgatcgaagaggtgatgagatctcgctggagccggaagatgctgatgacagggacccttgccgtcttcctgctcctgattatgggacaactgacctggaatgaccttatcagactgtgcattatggtgggcgccaacgcttccgatcgcatgggcatggggacaacgtatctcgccctgatggcgacctttaaaatgagacctatgttcgctgttggactcctgtttcggcgccttacatctagagaggtgctgctcctgaccatcggcctgagccttgtcgcctccgtggaactgcccaactctctcgaggaactgggggacggactcgccatgggcattatgatgctgaaacttctgacagagttccagccccaccagctctggaccacgctgctgagccttacatttatcaaaaccaccctgtccctcgattacgcttggaagacaaccgccatggctctgagcatcgtgtctctcttccctctgtgtctttccacaacgagccagaaaaccacatggctgccggtcctgctcgggtcttttggatgcaagcccctgaccatgttccttattacagaaaataagatctggggccggaaatcctggcctctgaacgagggcattatggccatcgggattgttagcatcctcctgtcttccctcctgaagaatgacgtgccccttgcgggacctctgatcgccggcgggatgctgattgcttgttatgtgatcagcggatccagcgccgatctctctctggagaaagctgccgaagtcagctgggagcaagaagccgagcattccggcacctctcacaacattcttgtggaagttcaggacgatgggacgatgaagatcaaagacgaggagcgcgatgacaccctgacaattctcctgaaggctaccctcctggcggtgagcggagtctaccccatgtccatccctgccacactttttgtgtggtatttctggcagaaaaagaagcagagatctggcgttctgtgggatacccccagcccgcctgaagtggagcgggctgtcctggacgatggcatctaccgcattctccaaagagggctgcttggacggtcccaggtgggcgtcggggtgttccaggacggagtttttcatacaatgtggcacgtgacgcgcggcgccgtcctgatgtatcaggggaaaagactcgaaccctcttgggccagcgtgaagaaagacctgatctcctacggaggcggctggcggttccaagggagctggaataccggagaggaggttcaggtgattgctgtcgaacctggcaagaaccccaaaaatgtgcagacaaccccggggacctttaagacacctgagggagaagtgggcgccatcgcgctcgatttcaagcccgggacgtctggatcccctattgttaacagagagggcaaaatcgtcggcctgtacgggaatggagtggtgaccacaagcggcacctatgtctctgctattgcccaagccaaggcttcccaggaagggccccttcccgagatcgaggacgaagtgtttaaaaagcgcaacctgacaatcatggatctgcaccctggaagcggcaaaacccggagatacctcccggccattgttcgcgaggcgatcaagcggaagctgagaacgcttattctggctcccacacgcgtggtcgcctccgaaatggccgaggctctcaaagggatgcctatccggtatcagaccaccgccgtgaagtctgaacatacaggcagagagattgttgacctgatgtgccacgctaccttcacaatgcgcctgctcagccccgtgcgggtccctaattacaacatgatcatcatggatgaggcccattttaccgaccccgcgtccattgccgctagaggatatatcagcacgcgggtgggcatgggggaagccgctgccattttcatgacagccacccctccgggatctgttgaggcttttccccagtccaatgcggtgatccaagatgaggaacgcgacattcctgaaagaagctggaactctggctacgattggatcacagacttccccgggaaaaccgtctggtttgtgcctagcatcaagtccggaaatgatattgccaactgtcttcggaaaaacggcaagcgcgtgatccagctgtctagaaagacgttcgacaccgagtatcagaaaacaaagaataacgactgggattacgtcgttaccacagacattagcgagatgggggctaatttccgggccgatagagtgatcgacccccgccggtgcctgaaaccggtgattctcaaggatggccctgaaagagtcatcctggccggacccatgcccgtgaccgttgcttccgccgcgcagcgccggggcagaattgggcgcaaccaaaataaagagggagaccagtacgtgtatatgggccagcctcttaacaatgatgaagaccacgctcattggacagaggccaagatgctgctcgataacatcaatacccccgaggggatcattcctgccctgtttgaaccggagcgggaaaagtctgctgccatcgacggagagtacagactgcgcggcgaagcgagaaaaacgttcgtcgagctcatgcggcgcggggatcttcccgtgtggctgagctataaggttgcctccgagggctttcagtacagcgacagacggtggtgcttcgatggagaacgcaacaatcaagtgctggaggaaaacatggacgtcgagatttggacaaaagaaggcgagagaaagaaactccggcctagatggctggacgctcgcacctattctgatccccttgccctgcgggagtttaaggagttcgctgccgggagacgctccgtgagcggagacctcatcctggagattggcaaactgcctcagcacctcacccttaaggctcagaatgccctggataacctggtcatgctccacaattccgaacaagggggaaaggcgtaccggcatgccatggaggaactgcccgacacaatcgagacccttatgctgctcgctctgatcgccgtgctgacaggcggcgttacgctctttttcctttctgggaaaggactgggcaagaccagcattgggctgctctgtgtgacagcttcctctgccctgctttggatggccagcgtggagccgcactggatcgctgcgtccattatcctggaatttttcctcatggtcctgctgattcctgagcccgatagacaacggacccctcaggacaaccagctcgcctatgttgtgatcggacttctgtttatgatcctgacagtggctgccaacgaaatgggcctcctggagaccacgaaaaaggatcttgggattggacatgtcgccgctgagaatcaccaacacgccaccatgctggacgtggatctccgccccgcgagcgcctggacactgtacgctgttgccaccacagtgatcacccctatgatgagacatacgattgaaaacacaaccgctaatatctctctgacagccattgcgaaccaggccgctatcctcatgggccttgacaaaggctggcccatttccaagatggatatcggggtcccgctgctggccctcggatgctacagccaggtgaatcctctgacccttaccgctgccgtcctgatgctcgtggctcactatgccatcattggccccgggctgcaggcgaaggccacacgggaggctcaaaaacgcacggccgctggaatcatgaagaaccccaccgttgacggcattgtggccatcgatctggaccctgtcgtgtacgacgccaaattcgaaaagcagctcgggcagattatgcttctgatcctgtgtacatctcagatcctcctgatgagaaccacatgggcgctttgcgagtccattaccctggctacgggaccgctcacaaccctgtgggaaggcagccccggcaaattttggaataccacaatcgccgtttctatggctaacattttccgggggagctatctggccggagccggcctcgctttctcccttatgaagtctctcgggggaggccgcagagggaccggagcccaaggcgagacactgggcgagaagtggaaacggcagctcaatcagctgagcaagtccgaatttaacacgtacaaacgcagcgggatcatggaggtggatagatccgaagcgaaggagggacttaaacggggcgaaaccacaaagcatgccgtctctagagggaccgctaagctgcgctggttcgtggagcggaatctcgtgaaacctgagggaaaggttattgacctgggctgtgggagaggaggctggagctattactgcgccggcctgaaaaaggtcacagaagtgaaagggtataccaagggaggccccgggcacgaggaacctatccccatggctacgtacggatggaacctcgtgaaacttcattccggcaaggatgtctttttcatgcctccggagaagtgtgacaccctgctgtgcgatatcggggaatctagccccaatcctacaattgaggagggacgcaccctccgggttctgaaaatggtggaaccctggcttagaggcaaccagttttgtatcaagattctgaatccttacatgccctccgtggtcgagacactcgaacaaatgcagcgcaaacacggcgggatgctggtgcggaacccgctgtctagaaatagcacccacgagatgtattgggtttcctgcggaacaggcaacatcgtgagcgccgtcaacatgacctctcgcatgctcctgaatcggttcacgatggcgcatagaaagcctacatttgagcgcgacgtggatcttggggccggaacccggcacgttgctgtggaacccgaggtcgccaacctggacattatcggccagagaattgaaaatatcaaaaacgagcataagtccacctggcactacgatgaagacaatccctataagacatgggcttaccacgggagctatgaggtgaaaccttctggatccgccagctctatggtgaacggcgtcgttcgcctcctgacgaagccctgggatgtgatccctatggtgacccaaattgctatgacagacaccacaccgttcggccagcagagagtctttaaagagaaggtggacacccggacaccccgcgccaaaagagggaccacgcagatcatggaagttaccgcgaagtggctttggggattcctgtcccggaataagaaacctagaatttgtacacgggaggaatttacccgcaaggtgagaagcaacgccgctatcggcgccgtcttcgtggatgagaatcaatggaactccgctaaagaagccgttgaggacgagcggttttgggatctcgtgcatcgcgaaagagagctgcacaagcaggggaaatgcgccacatgcgtctacaatatgatgggaaagcgggaaaagaaactgggcgagttcgggaaggcgaaaggcagccgcgctatttggtatatgtggctcggagccagattcctggaatttgaggcccttggcttcatgaacgaggaccattggttttctcgggaaaatagcctgtccggggtggagggagaaggcctccacaagctggggtacatccttcgcgatatctctaaaattcccggaggcaacatgtacgctgacgataccgccgggtgggacacgagaatcacagaggatgacctgcagaatgaggctaagattaccgatatcatggaacctgagcatgccctcctggcgacaagcattttcaaactgacctatcagaacaaggttgtgcgggtccaacgccccgccaagaacggcacggtgatggacgtcatctccagacgggatcagcgcggatctggccaggtggggacctacggactcaatacatttaccaacatggaagttcagctgatcagacaaatggagagcgaaggcattttccttccgtccgagctggagacacctaatctcgctgaacgggtgctggactggcttgagaaacacgggaccgaaagactgaagcgcatggccatctctggagacgattgtgtcgtgaaacccattgacgatcggtttgctacagccctcaccgcgctgaacgacatgggcaaggtgagaaaagatatccctcagtgggagcccagcaaggggtggaatgactggcagcaggttcctttctgctcccaccattttcaccaactgattatgaaggatggccgcgaaatcgtggtcccctgtcggaaccaggacgagctcgtgggcagagctcgcgttagccagggagctgggtggtctctgcgggagacggcctgccttggaaaatcctatgctcaaatgtggcagctgatgtacttccatagacgcgatctccggctggccgctaatgccatctgtagcgcggtgccggtcgactgggtgcctacatctagaaccacctggtccattcacgcccaccatcagtggatgacaaccgaagatatgcttagcgtctggaaccgcgtgtggatcgaggaaaatccctggatggaggacaagacacacgtttcctcttgggaagaggtgccctatctgggcaaacgggaggaccagtggtgcgggagcctcattggactgacggctagagccacctgggccacaaacatccaagtcgctattaatcaggtgcggagactgatcggcaacgaaaattacctcgattatatgacctccatgaagcgctttaaaaacgagagcgaccctgaaggggccctgtggtga

SEQ ID NO: 18621 - RNA, 9879 nt, synthetic construct
  misc_feature 1..9879: note = derived and/or modified CDS sequence (opt5) from DENV-1__GQ868518__SS-prME
  source 1..9879: mol_type = other RNA
agcgtgaccatgctgctcatgctgcttcccacagccctggctttccacctcacgacccggggcggggaacctcatatgatcgtctccaagcaggaacggggaaagtctctgctttttaagacaagcgccggcgttaacatgtgcaccctgattgcgatggacctcggggaactgtgtgaagatacaatgacctacaaatgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaagctgccgaagtgagctgggagcaagaagccgagcattccggcccctctcacaacattctggttgaagtgcaggacgatgggaccatgaagatcaaagacgaggagcgcgatgacacgcttaccattctgctcaaggctacactgctcgcggtcagcggagtgtaccctatgtccatccccgccaccctgtttgtttggtatttctggcagaaaaagaagcagagatctggcgtgctttgggatacaccgagccctcccgaagtcgagcgggctgtgctggacgatggcatctaccgcattctgcaaagagggctcctgggacggtcccaggtcggcgtgggggttttccaggacggagtgtttcataccatgtggcacgtcacacgcggcgccgtgcttatgtatcaggggaaaagactggaaccttcttgggccagcgttaagaaagacctcatctcctacggaggcggctggcggttcagagggagctggaatacgggagaggaggtgcaagtcattgctgtggaacccggcaagaacccgaaaaatgtgcagaccacacctgggacctttaagacccccgagggagaagttggcgccatcgcgctggatttcaagcctgggacatctggatcccccattgtcaaccgcgagggcaaaatcgtgggcctctacgggaatggagtggtcacgaccagcggcacatatgtgtctgctattgcccaggccaaggcttcccaagaagggcccctgcctgagatcgaggacgaagtttttaaaaagcggaaccttaccatcatggatctgcacccgggaagcggcaaaacaagacgctacctgcccgccattgtgcgggaggcgatcaagagaaagctccgcaccctgattcttgctcctacgcgggtcgtggcctccgaaatggccgaggctctgaaagggatgcccatcagatatcagacaaccgccgttaagtctgaacataccggccgcgagattgtggacctcatgtgccacgctacattcaccatgcggctgctgagccctgtcagagtgcccaattacaacatgatcatcatggatgaggcccattttacagaccctgcgtccattgccgctcggggatatatcagcacccgcgttggcatgggggaagccgctgccattttcatgacggccacaccgcccggatctgtggaggcttttcctcagtccaatgcggtcatccaggatgaagagagagacattcccgaacggagctggaactctggctacgattggatcaccgacttccctgggaaaacagtgtggtttgtgcccagcatcaagtccggaaatgatattgccaactgtctccgcaaaaacggcaagagagtcatccaactttctcggaagaccttcgacacggagtatcagaaaaccaagaataacgactgggattacgttgtgacaaccgacattagcgagatgggggctaatttcagagccgatcgcgtgatcgacccgcggagatgcctgaaacctgtcattctgaaggatggccccgaacgcgtgatcctcgccggacccatgcctgttacagtggcttccgccgcgcagcggagaggccgcattgggcggaaccagaataaagagggagaccaatacgtctatatgggccagcccctgaacaatgatgaagaccacgctcattggaccgaggccaagatgcttctggataacatcaatacacctgaggggatcattccggccctctttgaacccgagagagaaaagtctgctgccatcgacggagagtaccgcctgagaggcgaagcgcggaaaaccttcgtggagctgatgcgcagaggggatctccctgtttggcttagctataaggtggcctccgagggctttcagtacagcgaccggcgctggtgcttcgatggagaaagaaacaatcaggtcctggaggaaaacatggacgtggagatttggacgaaagaaggcgagcggaagaaactgagaccccgctggctcgacgctcggacatattctgatcctctggcccttagagagtttaaggagttcgctgccgggcgccggtccgtcagcggagacctgatcctcgagattggcaaactgccccaacacctgacctccagagctcagaatgccctcgataaccttgtgatgctgcacaattctgaacaagggggaaaggcgtaccggcatgccatggaggaactgccggacaccatcgagacactcatgctgcttgctctgatcgccgttctcaccggcggcgtgacactgtttttcctgagcgggaagggactcggcaaaacgtccattgggcttctgtgtgtgaccgcttctagcgccctgctctggatggcctccgtcgagcctcactggatcgctgcgagcattatcctggaatttttccttatggttctgctcattcccgagcctgatcgccagagaacaccccaagacaaccagctggcctatgtggtgatcggactgctctttatgatccttaccgtcgctgccaacgaaatgggcctgctggagacaaccaagaaagatctcgggattggacatgtggccgctgagaatcaccagcacgccacgatgctggacgttgatcttcggcctgcgtctgcctggaccctgtacgctgtggccacaaccgtcatcacacccatgatgcgccataccattgaaaacacgacagctaatatctccctcaccgccattgcgaaccaagccgctatcctgatgggcctggacaagggctggccgattagcaaaatggatatcggggtgcctctccttgccctgggatgctactctcaggtcaatcccctgacactcaccgctgccgtgctgatgcttgttgctcactatgccatcattggccccgggctgcaggcgaaggccaccagagaggctcagaagcggacagccgctggaatcatgaaaaaccctacggtggacggcattgtcgccatcgatctcgacccggtggtttacgacgccaagttcgaaaaacaactggggcagattatgctgctcatcctttgtacctcccagatcctgctgatgcgcacaacctgggcgctctgcgagagcattacactggctaccggaccccttacgacactgtgggaaggctctcctggcaagttttggaataccaccatcgccgtgagcatggctaacattttcagagggtcctatctcgccggagccggcctggctttctctctgatgaaaagcctcgggggaggccggcgcgggacaggagcccagggcgagacccttggcgagaagtggaagagacaactgaatcagctgtccaaaagcgaatttaacacatacaagcggtccgggatcatggaggtcgatagatctgaagcgaaagagggactcaagcgcggcgaaacgaccaaacatgccgtgagccgggggacagctaagctgagatggttcgtggagcgcaatcttgttaagcccgagggaaaagtcattgacctgggctgtgggcggggaggctggtcctattactgcgccggcctcaagaaagtgaccgaagtgaaggggtatacaaaaggaggccctgggcacgaggaacccatccctatggctacctacggatggaacctggtcaagctgcattctggcaaagatgtgtttttcatgccgcccgagaagtgtgacacgctcctttgcgatatcggggaaagctcccctaatcccaccattgaggagggaagaacactgcgcgttctgaagatggtggaaccttggctccggggcaaccagttttgtatcaaaattctgaatccctacatgccgtctgtcgtggagacccttgaacagatgcaaagaaagcacggcgggatgctggttcgcaaccctctcagcagaaattccacacacgagatgtattgggtgagctgcggaaccggcaacatcgtctctgccgtgaacatgacatccagaatgctgctgaatcgcttcaccatggcgcatcggaaacccacgtacgagagagacgttgatctcggggccggaacacgccacgtggctgtcgaacccgaggtggccaacctggacattatcggccagagaattgaaaatatcaagaacgagcataaaagcacctggcactatgatgaagacaatccttacaagacctgggcttatcacgggtcttacgaggtgaagccctccggaagcgcctcttccatggtcaacggcgttgtgcggcttctgacaaaaccttgggatgtgatcccgatggtcacgcagattgctatgaccgacacaaccccctttggccaacagcgcgtgttcaaggagaaagttgacacaagaacccctcgggccaagagagggacaacccagatcatggaagtgacggcgaaatggctctggggatttctgagccggaataagaagccccgcatttgtaccagagaggagttcacacggaaagtccgctccaacgccgctatcggcgccgtgtttgttgatgagaatcagtggaacagcgctaaggaagccgtggaggacgagagattctgggatcttgtccatcgggaacgcgagctgcacaaacaagggaagtgcgctacctgcgtgtataatatgatgggaaaaagagaaaagaagctcggcgagtttgggaaagcgaagggctctcgggctatttggtacatgtggctgggagcccgcttcctggagttcgaggccctcggctttatgaacgaggaccattggttcagcagagaaaattccctgtctggggttgagggagaaggccttcacaaactggggtacatcctccgggatatcagcaagattcctggaggcaacatgtatgctgacgatacagccgggtgggacacccgcatcacggaggatgacctgcagaatgaggctaaaattacagaaatcatggagcccgaacatgcccttctggcgacctccatttttaagctcacataccagaacaaagtggtcagagtgcagcggccggccaagaacggcaccgtcatggatgtgatctctcgcagagaccaacggggaagcggccaggttgggacgtatggactgaataccttcacaaacatggaggtgcagctgatcagacagatggaatccgagggcatttttctcccttctgagctggaaacccccaatcttgctgagcgcgtcctggattggctcgaaaagcacggggccgagcggctgaaaagaatggctatcagcggagacgactgtgtggtgaagcctattgatgaccgcttcgccacagcgcttaccgccctgaacgatatgggcaaagttcggaaggacatcccccaatgggaaccttccaaagggtggaatgattggcaacaggtgcccttttgcagccaccatttccaccagctcattatgaaggacggcagagagatcgtcgtgccgtgtcgcaaccaagatgagctggttggacgggctagagtgtctcagggcgccgggtggtccctgcgcgaaacagcttgcctcggaaagagctacgcccagatgtggcaactgatgtattttcatcggagagaccttcgcctggctgccaatgcgatctgttctgccgtccctgtggattgggtccccacctcccggacgacatggagcattcacgctcaccatcagtggatgaccaccgaggacatgctctccgtgtggaacagagtttggatcgaagagaatccctggatggaagataaaacacacgtgtctagctgggaggaggtcccttacctgggcaagcgggaagaccagtggtgcgggtcccttattggactgaccgccagagccacatgggctacgaacatccaggtggccattaatcaagttcgccggctcatcggcaacgagaattatctggactacatgaccagcatgaaaagattcaagaacgaatctgatccggagggggcgctgtggtga

SEQ ID NO: 18622 - RNA, 9879 nt, synthetic construct
  misc_feature 1..9879: note = derived and/or modified CDS sequence (opt5) from DENV-1__GQ868519__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttcctcacccaggacgaaaagggggtgacacagaacggaagactgatcacggctaatcccattgtcaccgataaagagaagcctgtgaacatcgaaacagagcccccctttggcgagtcttatattgtggttggggccggagaaaaagccctgaagctctcctggttcaagaaaggcagctctatcgggaagatgtttgaggctaccgcccggggcgctagacgcatggccattctgggagacacagcgtgggatttcggcagcatcgggggagtctttacctccgtgggcaaacttgtgcatcaggtcttcgggacggcctacggagtgctgttttctggcgttagctggaccatgaagatcgggattggcatcctcctgacatggctgggacttaattcccggagcacctctctctccatgacatgtattgctgtgggcatggtcaccctgtacctgggggtgatggttcaagccgacagcggatgcgtgatcaactggaaaggcagagaactcaagtgtgggtctggaattttcgtcacaaacgaggtgcacacctggacggaacagtataagtttcaggctgattcccctaaacgcctgagcgccgcgatcggcaaggcctgggaggagggggtttgcggcattcggtccgctacaagacttgaaaatatcatgtggaaacagatctctaacgagctgaatcatattctcctggaaaacgacatgaagttcaccgtggtcgtgggagacgccaatggcatcctggctcaagggaaaaagatgattcgcccgcagcccatggagcacaaatacagctggaagtcctggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggcttaagctcagagactcttacacccaaatgtgcgatcaccgcctgatgagcgcggccattaaagactccaaggctgtccatgccgatatgggctattggatcgaaagcgagaaaaacgaaacatggaagctggcccgggcttctttcatcgaggttaagacctgtacatggcccaaatcccacaccctctggagcaatggggtgctggaatctgagatgattatcccgaagatttacggaggccctatctcccagcataactatagacccgggtacttcacgcagaccgccggaccttggcaccttggcaaactggagctcgactttgatctgtgcgaagggacaaccgtggtcgtggacgagcactgcggaaatcgcggccccagcctgcggacaaccacggttacaggcaagattatccatgaatggtgttgcagatcttgtacccttcctcccctccggttccgcggggaggatggatgctggtacggcatggagatcagaccggtgaaagaaaaggaggaaaacctggtccggagcatggtgtccgcggggagcggagaggttgactctttttccctgggcattctctgtgctagcatcatgattgaagaggtgatgagatcccgctggtctcggaagatgctgatgacagggacccttgccgtcttcctgctcctggtgatgggacaactgacctggaatgaccttatcagactgtgcattatggttggcgccaacgctagcgatcgcatgggcatggggacaacgtatctcgccctgatggcgacctttaaaatgagacctatgttcgctgtgggactcctgtttcggcgccttacatccagagaggtcctgctcctgaccatcggcctgtctcttgtggccagcgtggaactgcccaactccctcgaggaactgggggacggactcgccatgggcattatgatgctgaagcttctgacagagttccagccccaccagctctggatcaccctgctgtctcttacgtttatcaaaacaaccctgagcctcgattacgcttggaagaccacagccatggctctgtccattgtcagcctcttccctctgtgtctttctaccacatcccagaaaacgacctggctgccggttctgctcgggagctttggatgcaagcccctgacaatgttccttatcaccgaaaataagatttggggccggaaatcttggcctctgaacgagggcatcatggccattgggatcgtgtccatcctcctgagctctctcctgaagaatgacgtgccccttgcgggacctctgattgccggcgggatgctgatcgcttgttatgtcatttccggaagctccgccgatctcagcctggagaaagctgccgaagtgtcttgggagcaagaagccgagcatagcggcacatcccacaacatccttgttgaagtgcaggacgatgggaccatgaagattaaagacgaggagcgcgatgacacgctgaccatcctcctgaaggctacactcctggcggtctctggagtgtaccccatgagcatccctgccaccctttttgtttggtatttctggcagaaaaagaagcagagatccggcgtgctgtgggatacaccctctccgcctgaagtcgagcgggctgtgctggacgatggcatttaccgcatcctccaaagagggctgcttggacggagccaggtcggcgtgggggttttccaggacggagtgtttcataccatgtggcacgtcacacgcggcgccgtgctgatgtatcaggggaaaagactcgaaccctcctgggcctctgttaagaaagacctgattagctacggaggcggctggcggttccaagggtcctggaatacgggagaggaggtgcaggtcatcgctgtggaacctggcaagaaccccaaaaatgtgcagaccatgccggggacatttaagacccctgagggagaagttggcgccattgcgctcgatttcaagcccgggaccagcggatctcctatcgtcaacagagagggcaaaattgtgggcctgtacgggaatggagtggtcacaacgtccggcacctatgtgagcgctatcgcccaagccaaggcttctcaggaagggccccttcccgagatcgaggacgaagtttttaaaaagcgcaacctgacaattatggatctgcaccctggatccggcaaaacccggagatacctcccggccatggtgcgcgaggcgatcaagcggaagctgagaacacttattctggctcccacccgcgtcgtggccagcgaaatggccgaggctctcaaagggatgcctatccggtatcagacgacagccgttaagtccgaacataccggcagagagattgtggacctgatgtgccacgctaccttcacaatgcgcctgctctctcccgtccgggtgcctaattacaacatgatcatcatggatgaggcccattttaccgaccccgcgagcattgccgctagaggatatatctccacacgggttggcatgggggaagccgctgccattttcatgaccgccacgcctccgggaagcgtggaggcttttccccagtctaatgcggtcatccaagatgaagagcgcgacattcctgaaagatcctggaacagcggctacgattggatcacagacttccccgggaaaaccgtgtggtttgtgccttctatcaagagcggaaatgatattgccaactgtcttcggaaaaacggcaagcgcgtcatccagctgtccagaaagacattcgacaccgagtatcagaaaacgaagaataacgactgggattacgttgtgaccacagacatttctgagatgggggctaatttccgggccgatagagtgatcgacccccgccggtgcctgaaaccggtcattctcaaggatggccctgaaagagtgatcctggccggacccatgcccgttaccgtggctagcgccgcgcagcgccggggcagaattgggcgcaaccaaaataaagagggagaccagtacgtctatatgggccagcctcttaacaatgatgaagaccacgctcattggacagaggccaagatgctgctcgataacatcaatacccccgaggggatcattcctgccctgtttgaaccggagcgggaaaagtccgctgccatcgacggagagtacagactgcgcggcgaagcgagaaaaacattcgtggagctcatgcggcgcggggatcttcccgtttggctgtcttataaggtggccagcgagggctttcagtactccgacagacggtggtgcttcgatggagaacgcaacaatcaagtcctggaggaaaacatggacgtggagatttggaccaaagaaggcgagagaaagaaactccggcctagatggctggacgctcgcacgtatagcgatccccttgccctgcgggagtttaaggaattcgctgccgggagacgctctgtctccggagacctcatcctggagattggcaaactgcctcagcacctcacacttcgggctcagaatgccctggataacctggtgatgctccacaatagcgaacaggggggaaaggcgtacagacatgccatggaggaactgcccgacaccatcgagacccttatgctgctcgctctgatcgccgttctgacaggcggcgtgaccctctttttcctttccgggaagggactgggcaaaacatctattgggctgctctgtgtgacggctagctccgccctgctttggatggcctctgtcgagccgcactggatcgctgcgagcattatcctggaatttttcctcatggttctgctgattcctgagcccgatcggcaacgcacccctcaggacaaccagctcgcctatgtggtgatcggacttctgtttatgatcctgacagtcgctgccaacgaaatgggcctcctggagaccacaaagaaagatcttgggattggacatgtggccgctgagaatcaccaacacgccaccatgctggacgttgatctcagacccgcgtccgcctggacgctgtacgctgtggccaccacagtcatcacccctatgatgcggcatacaattgaaaacaccacggctaatatcagcctgacagccattgcgaaccaggccgctatcctcatgggccttgacaagggctggcccatttctaaaatggatatcggggtgccgctgctggccctcggatgctactcccaggtcaatcctctgacccttacagctgccgtgctgatgctcgttgctcactatgccatcattggccccgggctgcaggcgaaggccacccgcgaggctcaaaagagaaccgccgctggaatcatgaaaaaccccacagtggacggcattgtcgccatcgatctggaccctgtggtttacgacgccaagttcgaaaaacagctcgggcagattatgcttctgatcctgtgtacgagccagatcctcctgatgcggaccacatgggcgctttgcgagtctattaccctggctacaggaccgctcaccacgctgtgggaaggctcccccggcaagttttggaatacaaccatcgccgtgagcatggctaacattttccgcgggtcttatctggccggagccggcctcgctttcagccttatgaaatccctggggggaggcagacgggggaccggagcccaaggcgagacactgggcgagaagtggaagcgccagctcaatcagctgtctaaaagcgaatttaacacctacaagagatccgggatcatggaggtcgatcggagcgaagcgaaagagggacttaagagaggcgaaacaacgaaacatgccgtgtcccgcgggaccgctaagctgcggtggttcgtggagagaaatctcgttaagcctgagggaaaagtcattgacctgggctgtgggcgcggaggctggtcttattactgcgccggcctgaagaaagtgacagaagtgaaggggtataccaaaggaggccccgggcacgaggaacctatccccatggctacatacggatggaacctcgtcaagcttcatagcggcaaagatgtttttttcatgcctccggagaagtgtgacaccctgctgtgcgatatcggggaatcctctcccaatcctacgattgaggagggacggaccctcagagtgctgaagatggtggaaccctggcttcgcggcaaccagttttgtatcaaaattctgaatccttacatgcccagcgtcgtggagacactcgaacaaatgcagcggaagcacggcgggatgctggttagaaacccgctgtcccgcaattctacccacgagatgtattgggtgagctgcggaacaggcaacatcgtctccgccgtgaacatgaccagccggatgctcctgaatagattcacaatggcgcatcgcaaacctacctacgagcgggacgttgatcttggggccggaacgagacacgtggctgtcgaacccgaggtggccaacctggacattatcggccagcgcattgaaaatatcaagaacgagcataaatctacatggcactatgatgaagacaatccctacaagacctgggcttatcacgggtcctacgaggtgaagcctagcggatctgcctccagcatggtcaacggcgttgtgagactcctgaccaaaccctgggatgtgatccctatggtcacacaaattgctatgacggacaccacaccgtttggccagcagcgggtgttcaaggagaaagttgacacccgcacacccagagccaagcgggggaccacacagatcatggaagtgaccgcgaaatggctttggggatttctgtctagaaataagaagcctcggatttgtacgcgcgaggaattcaccagaaaagtccggtccaacgccgctatcggcgccgtgtttgttgatgagaatcaatggaacagcgctaaggaagccgtggaggacgagcgcttctgggatctcgtccatagagaacgggagctgcacaaacaggggaagtgcgccacatgcgtgtataatatgatgggaaaacgcgaaaagaagctgggcgagtttgggaaagcgaagggctccagagctatttggtacatgtggctcggagcccggttcctggaattcgaggcccttggctttatgaacgaggaccattggttcagccgcgaaaattctctgagcggggttgagggagaaggcctccacaaactggggtacatccttagagatatctccaagattcccggaggcaacatgtatgctgacgataccgccgggtgggacacacggatcaccgaggatgacctgcagaatgaggctaaaattacggaaatcatggagcctgaacatgccctcctggcgacatctatttttaagctgacctaccagaacaaagtggtccgcgtgcaaagacccgccaagaacggcacagtcatggatgtgatcagccggcgcgaccagagaggatccggccaggttgggacctatggactcaatacgttcaccaacatggaggtgcagctgatccggcaaatggaatctgagggcatttttcttccgagcgagctggaaacacctaatctcgctgagagagtcctggattggcttgaaaagcacggggccgagcgcctgaaacggatggctatctccggagacgactgtgtggtgaagcccattgatgacagattcgccaccgcgctcacagccctgaacgatatgggcaaagttcgcaaggacatccctcagtgggaaccctctaaagggtggaatgattggcagcaggtgcctttttgcagccaccatttccaccaactgattatgaaggacggccgggagatcgtcgtgccctgtagaaaccaggatgagctcgttggacgcgctcgggtgtcccagggcgccgggtggagcctgagagaaaccgcttgccttggaaagtcttacgcccaaatgtggcagctgatgtattttcatcgccgggacctcagactggctgccaatgcgatctgttccgccgtcccggtggattgggtccctacaagccgcaccacgtggtctattcacgctcaccatcagtggatgacaaccgaggacatgctttccgtgtggaaccgggtttggatcgaagagaatccctggatggaagataaaacccacgtgagctcctgggaggaggtcccctacctgggcaagagagaagaccagtggtgcgggtctctcattggactgacagcccgggccacctgggctacaaacatccaagtggccattaatcaggttagacgcctgatcggcaacgagaattatctcgactacatgacgagcatgaaacggttcaagaacgaatccgatcctgagggggcgctgtggtga

SEQ ID NO: 18623 - RNA, 9879 nt, synthetic construct
  misc_feature 1..9879: note = derived and/or modified CDS sequence (opt5) from DENV-1__KF955443__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagatgagcggaaccacaaccatttttgctggccatcttaaatgccgcctgaagatggacaaactcacactgaaggggacctcctatgttatgtgtacgggcagcttcaaactggagaaggaagtggccgagacacagcacggaaccgtccttgtgcaagttaagtacgagggcaccgatgcgccgtgcaaaatccctttctctacacaggacgaaaagggggtgacccagaacggaagactcatcacagctaatcccattgtcacggataaagagaagcctgtgaacatcgaaaccgagcccccctttggcgagtcctatattgtggttggggccggagaaaaagccctgaagctgagctggttcaagaaaggctctagcatcgggaagatgtttgaggctacagcccggggcgctagacgcatggccattctcggagacaccgcgtgggatttcggctccatcgggggagtctttacatctgtgggcaaactggtgcatcaggtcttcgggaccgcctacggagtgctttttagcggcgtttcctggacgatgaagatcgggattggcatcctgctcacctggctgggactgaatagccggtctacatcccttagcatgacctgtattgctgtgggcatggtcacactctacctgggggtgatggttcaagccgactctggatgcgtgatcaactggaaaggcagagaactgaagtgtgggtccggaattttcgtcaccaacgaggtgcacacatggaccgaacagtataagtttcaggctgatagccctaaacgcctctccgccgcgatcggcaaggcctgggaggagggggtttgcggcattcggtctgtgacgagactggaaaatatcatgtggaaacagatcagcaacgagcttaatcatattctgctcgaaaacgacatgaagttcacagtcgtggtgggagacgctaatggcatcctggcccaagggaaaaagatgattcgcccgcagcccatggagcacaaatactcctggaagtcttggggaaaggctaaaatcattggcgccgatatccagaacaccacctttatcattgacgggcctgatacacccgaatgtcctgacaatcagcgggcctggaacatctgggaggtcgaggattatggattcggcatttttaccacgaatatctggctgaagcttagagacagctacacacaaatgtgcgatcaccgcctcatgtccgctgcgattaaagacagcaaggccgttcatgctgatatgggctattggatcgaatctgagaaaaacgaaacctggaagctggcccgggcctccttcatcgaggtgaagacatgtacctggcccaaaagccacacactgtggtctaatggggtgctcgaatccgagatgattatcccgaagatttacggaggccctatcagccagcataactatagacccgggtacttcacccagacggctggaccttggcacctgggcaaacttgagctggactttgatctctgcgaagggaccacagtcgtggttgacgagcactgcggaaatcgcggcccctctctgcggaccacaaccgtgacgggcaagattatccatgaatggtgttgcagaagctgtacactgcctccccttcggttccgcggggaggatggatgctggtacggcatggagatcagaccggtcaaagaaaaggaggaaaacctcgtgcggtccatggttagcgccgggtctggagaggtggactcctttagcctgggcattctgtgtgcgtccatcatgattgaagaggtcatgagatctcgctggagccggaagatgctcatgaccgggacactggctgtgttccttctgctcatcatgggacaactgacctggaatgacctgattagactttgcatcatggttggcgccaacgcctccgatcgcatgggcatggggaccacatatctggctctcatggccacgtttaaaatgagacctatgttcgcggtgggactgctctttcggcgcctgacctctagagaggtccttctgctcacaattggcctgagcctggtggcttccgtggaacttcccaactctctggaggaactcggggacggactggccatgggcatcatgatgctcaagctgcttaccgagttccagccccaccagctgtggacaaccctcctgagcctgacgtttatcaaaacaaccctttccctggattacgcctggaagaccacagctatggccctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggctattgggatcgtgagcatcctgctctcttccctgctcaagaatgacgtgcccctggccggacctcttattgcgggcgggatgctgatcgcctgttatgtcattagcggatccagcgctgatctgtctctcgagaaagccgctgaagtgagctgggagcaagaagccgagcattccggcacatctcacaacatcctggttgaagtgcaggacgatgggaccatgaagattaaagacgaggagcgcgatgacacgcttaccatcctgctcaaggccacactgctcgctgtcagcggagtgtaccccatgtccatccctgcgaccctgtttctttggtatttctggcagaaaaagaagcagagatctggcgttctgtgggatacacccagcccgcctgaagtggagcgggccgtcctggacgatggcatttaccgcatcctccaaagagggctgcttggacggtcccaggtgggcgtcggggtgttccaggacggagtttttcataccatgtggcacgtgacacgcggcgctgtcctgatgtatcaggggaaaagactcgaaccctcttgggccagcgtgaagaaagacctgatttcctacggaggcggctggcggttccaagggagctggaatacgggagaggaggttcaggtgatcgccgtcgaacctggcaagaaccccaaaaatgtgcagaccacaccggggacctttaagacccctgagggagaagtgggcgctattgccctcgatttcaagcccgggacatctggatcccctatcgttaacagagagggcaaaattgtcggcctgtacgggaatggagtggtgacgaccagcggcacatatgtctctgcgatcgctcaagccaaggcctcccaggaagggccccttcccgagatcgaggacgaagtgtttaaaaagcgcaacctgaccattatggatctgcaccctggaagcggcaaaacacggagatacctcccggctatcgttcgcgaggccattaagcggaagctgagaacccttatcctggcgcccacgcgcgtggtcgcttccgaaatggccgaggccctcaaagggatgcctattcggtatcagacaaccgctgtgaagtctgaacataccggcagagagatcgttgacctgatgtgccacgccacattcaccatgcgcctgctcagccccgtgcgggtccctaattacaacatgatcattatggatgaggctcattttacagaccccgcctccatcgcggccagaggatatattagcacccgggtgggcatgggggaagctgccgctatcttcatgacggccacacctccgggatctgttgaggcctttccccagtccaatgctgtgattcaagatgaagagcgcgacatccctgaaagaagctggaactctggctacgattggatcaccgacttccccgggaaaacagtctggtttgtgcctagcattaagtccggaaatgatatcgcgaactgtcttcggaaaaacggcaagcgcgtgattcagctgtctagaaagaccttcgacacggagtatcagaaaaccaagaataacgactgggattacgtcgttacaaccgacatcagcgagatgggggccaatttccgggctgatagagtgattgacccccgccggtgcctgaaaccggtgatcctcaaggatggccctgaaagagtcattctggccggacccatgcccgtgacagttgcctccgctgcccagcgccggggcagaatcgggcgcaaccaaaataaagagggagaccagtacgtgtatatgggccagcctcttaacaatgatgaagaccacgcgcattggaccgaggctaagatgctgctcgataacatcaatacacccgaggggattatccctgccctgtttgaaccggagcgggaaaagtctgccgctattgacggagagtacagactgcgcggcgaagccagaaaaaccttcgtcgagctcatgcggcgcggggatcttcccgtgtggctgagctataaggttgcgtccgagggctttcagtacagcgacagacggtggtgcttcgatggagaacgcaacaatcaagtgctggaggaaaacatggacgtcgagatctggacgaaagaaggcgagagaaagaaactccggcctagatggctggacgcccgcacatattctgatccccttgctctgcgggagtttaaggaattcgccgctgggagacgctccgtgagcggagacctcattctggagatcggcaaactgcctcagcacctcacccttcgggcccagaatgctctggataacctggtcatgctccacaattccgaacaggggggaaaggcctacagacatgcgatggaggaactgcccgacaccatcgagacacttatgctgctcgccctgattgctgtgctgaccggcggcgttacactctttttcctttctgggaagggactgggcaaaacgagcatcgggctgctctgtgtgaccgcctcctctgctctgctttggatggccagcgtggagccgcactggattgccgcttccatcattctggaatttttcctcatggtcctgctgatccctgagcccgatcggcaacgcacacctcaggacaaccagctcgcgtatgttgtgatcggacttctgtttatgattctgaccgtggccgctaacgaaatgggcctcctggagacaaccaagaaagatcttgggatcggacatgtcgccgccgagaatcaccaacacgctacgatgctggacgtggatctcagacccgccagcgcgtggaccctgtacgccgttgctacaaccgtgattacacctatgatgcggcataccatcgaaaacacgacagccaatatttctctgaccgctatcgccaaccaggcggccattctcatgggccttgacaagggctggcccatctccaaaatggatatcggggtcccgctgctggctctcggatgctacagccaggtgaatcctctgacacttaccgccgctgtcctgatgctcgtggcccactatgctattatcggccccgggctgcaggccaaggcgacccgcgaggcccaaaagagaacagctgccggaattatgaaaaaccccacggttgacggcatcgtggctattgatctggaccctgtcgtgtacgacgccaagttcgaaaaacagctcgggcagatcatgcttctgatcctgtgtacctctcagattctcctgatgcggacaacctgggccctttgcgagtccatcacactggcgaccggaccgctcacgacactgtgggaaggcagccccggcaagttttggaataccaccattgctgtttctatggccaacatcttccgcgggagctatctggctggagccggcctcgccttctcccttatgaaatctctggggggaggcagacgggggacaggagctcaaggcgagaccctgggcgagaagtggaagcgccagctcaatcagctgagcaaatccgaatttaacacatacaagagaagcgggattatggaggtggatcggtccgaagccaaagagggacttaagagaggcgaaacgaccaaacatgcggtctctcgcgggacagccaagctgcggtggttcgtggagagaaatctcgtgaagcctgagggaaaagttatcgacctgggctgtgggcgcggaggctggagctattactgcgctggcctgaagaaagtcaccgaagtgaaggggtatacaaaaggaggccccgggcacgaggaacctatccccatggccacctacggatggacgctcgtgaagcttcattccggcaaagatgtctttttcatgcctccggagaagtgtgacaccctgctgtgcgatattggggaatctagccccaaccctacaatcgaggagggacggaccctcagagttctgaagatggtggaaccctggcttcgcggcaatcagttttgtattaaaatcctgaacccttacatgccctccgtggtcgagacactcgaacaaatgcagcggaagcacggcgggatgctggtgagaaatccgctgtctcgcaacagcacccacgagatgtattgggtttcctgcggaacaggcaatattgtgagcgctgtcaacatgacctctcggatgctcctgaacagattcacgatggcccatcgcaaacctacatttgagcgggacgtggatcttggggcgggaaccagacacgttgccgtggaacccgaggtcgctaatctggacatcattggccagcgcatcgaaaacatcaagaatgagcataaatccacctggcactacgatgaagacaacccctataagacatgggcctaccacgggagctatgaggtgaagccttctggatccgctagctctatggtgaatggcgtcgttagactcctgacgaaaccctgggatgtgattcctatggtgacccaaatcgccatgacagacaccacaccgttcggccagcagcgggtctttaaggagaaagtggacacccgcacacccagagctaagcgggggaccacgcagattatggaagttaccgccaaatggctttggggattcctgtccagaaacaagaagcctcggatctgtacacgcgaggaatttaccagaaaagtgcggagcaatgcggccattggcgctgtcttcgtggatgagaaccaatggaattccgccaaggaagctgttgaggacgagcgcttttgggatctcgtgcatagagaacgggagctgcacaaacaggggaagtgcgccacatgcgtctacaacatgatgggaaaacgcgaaaagaagctgggcgagttcgggaaagccaagggcagcagagcgatctggtatatgtggctcggagctcggttcctggaatttgaggcccttggcttcatgaatgaggaccattggttttctcgcgaaaacagcctgtccggggtggagggagaaggcctccacaaactggggtacatccttagagatatttctaagatccccggaggcaatatgtacgccgacgataccgctgggtgggacacgcggattacagaggatgacctgcagaacgaggccaaaatcaccgatattatggaacctgagcatgctctcctggccacaagcatcttcaagctgacctatcagaataaagttgtgcgcgtccaaagacccgcgaagaacggcacggtgatggacgtcatctcccggcgcgatcagagaggatctggccaggtggggacctacggactcaacacatttaccaatatggaagttcagctgattcggcaaatggagagcgaaggcatcttccttccgtccgagctggagacacctaacctcgccgaaagagtgctggactggcttgagaagcacggggctgaacgcctgaaacggatggccatttctggagacgattgtgtcgtgaagcccatcgacgatagatttgctaccgccctcacagcgctgaatgacatgggcaaagtgcgcaaggatattcctcagtgggagcccagcaaagggtggaacgactggcagcaggttcctttctgctcccaccattttcaccaactgatcatgaaggatggccgggaaatcgtggtcccctgtagaaatcaggacgagctcgtgggacgcgcccgggttagccagggcgctgggtggtctctgagagagaccgcctgccttggaaagtcctatgctcaaatgtggcagctgatgtacttccatcgccgggatctcagactggccgctaacgccatttgtagcgcggtgccggtcgactgggtgcctacgtctcgcacaacctggtccatccacgcccaccatcagtggatgaccacagaagatatgcttagcgtctggaatcgggtgtggattgaggaaaacccctggatggaggacaaaacccacgtttcctcttgggaagaggtgccctatctgggcaagagagaggaccagtggtgcgggagcctcatcggactgacagctcgggccacgtgggccaccaatattcaagtcgctatcaaccaggtgagacgcctgattggcaatgaaaactacctcgattatatgacatccatgaaacggtttaagaatgagagcgaccctgaaggggccctgtggtga

SEQ ID NO: 18624 - RNA, 9879 nt, synthetic construct
  misc_feature 1..9879: note = derived and/or modified CDS sequence (opt5) from DENV-1__GQ868520__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaagctgccgaagtgagctgggagcaagaagccgagcattccggcacctctcacaacattctggttgaagtgcaggacgatgggacgatgaagatcaaagacgaggagcgcgatgacacccttacaattctgctcaaggctaccctgctcgcggtcagcggagtgtaccccatgtccatccctgccacactgtttgtttggtatttctggcagaaaaagaagcagagatctggcgtgctttgggatacccccagcccgcctgaagtcgagcgggctgtgctggacgatggcatctaccgcattctgcaaagagggctcctgggacggtcccaggtcggcgtgggggttttccaggacggagtgtttcatacaatgtggcacgtcacgcgcggcgccgtgcttatgtatcaggggaaaagactggaaccctcttgggccagcgttaagaaagacctcatctcctacggaggcggctggcggttccaagggagctggaataccggagaggaggtgcaggtcattgctgtggaacctggcaagaaccccaaaaatgtgcagacaatgccggggacctttaagacccctgagggagaagttggcgccatcgcgctggatttcaagcccgggacatctggatcccctattgtcaacagagagggcaaaatcgtgggcctctacgggaatggagtggtcacgaccagcggcacatatgtgtctgctattgcccaagccaaggcttcccaggaagggcccctgcccgagatcgaggacgaagtttttaaaaagcgcaaccttaccatcatggatctgcaccctggaagcggcaaaacacggagatacctgccggccatggtgcgcgaggcgattaagcggaagctcagaaccctgatccttgctcccacgcgcgtcgtggcctccgaaatggccgaggctctgaaagggatgcctattcggtatcagacaaccgccgttaagtctgaacataccggcagagagatcgtggacctcatgtgccacgctacattcaccatgcgcctgctgagccccgtccgggtgcctaattacaacatgattatcatggatgaggcccattttacagaccccgcgtccatcgccgctagaggatatattagcacccgggttggcatgggggaagccgctgccatcttcatgacggccacacctccgggatctgtggaggcttttccccagtccaatgcggtcattcaagatgaagaacgcgacatccctgaaagaagctggaactctggctacgattggattaccgacttccccgggaaaacagtgtggtttgtgcctagcatcaagtccggaaatgatatcgccaactgtctccggaaaaacggcaagcgcgtcattcagctttctagaaagaccttcgacacggagtatcagaaaaccaagaataacgactgggattacgttgtgacaaccgacatcagcgagatgggggctaatttccgggccgatagagtgattgacccccgccggtgcctgaaaccggtcatcctgaaggatggccctgaaagagtgattctcgccggacccatgcccgttacagtggcttccgccgcgcagcgccggggcagaatcgggcgcaaccaaaataaagagggagaccagtacgtctatatgggccagcctctgaacaatgatgaagaccacgctcattggaccgaggccaagatgcttctggataacattaatacacccgaggggatcatccctgccctctttgaaccggagcgggaaaagtctgctgccattgacggagagtacagactgcgcggcgaagcgagaaaaaccttcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatctggacgaaagaaggcgagagaaagaaactgcggcctagatggctcgacgctcgcacatattctgatcccctggcccttcgggagtttaaggagttcgctgccgggagacgctccgtcagcggagacctgattctcgagatcggcaaactgcctcagcacctgaccctccgggctcagaatgcccttgataacctggtgatgctgcacaattccgaacaagggggaaaggcgtacagacatgccatggaggaactccccgacaccattgagacactgatgcttctggctctcatcgccgttctgaccggcggcgtgacactgtttttcctctctgggaagggacttggcaaaacgagcatcgggctgctgtgtgtgaccgcttcctctgccctcctgtggatggccagcgtcgagccgcactggattgctgcgtccatcattcttgaatttttcctgatggttctcctgatccctgagcccgatcggcaacgcacacctcaggacaaccagctggcctatgtggtgattggactcctttttatgatcctgaccgtcgctgccaacgaaatgggcctgctcgagacaaccaagaaagatctggggatcggacatgtggccgctgagaatcaccaacacgccacgatgcttgacgttgatctgagacccgcgagcgcctggaccctctacgctgtggccacaaccgtcattacacctatgatgcggcataccatcgaaaacacgacagctaatatttctctgaccgccatcgcgaaccaggccgctattctgatgggcctcgacaagggctggcccatctccaaaatggatattggggtgccgcttctggccctgggatgctacagccaggtcaatcctctcacactgaccgctgccgtgcttatgctggttgctcactatgccatcatcggccccgggctccaggcgaaggccacccgcgaggctcaaaagagaacagccgctggaattatgaaaaaccccacggtggacggcatcgtcgccattgatctggaccctgtggtttacgacgccaagttcgaaaaacagctggggcagatcatgctccttattctgtgtacctctcagatcctgctcatgcggacaacctgggcgctgtgcgagtccatcacacttgctaccggaccgctgacgacactctgggaaggcagccccggcaagttttggaataccaccattgccgtgtctatggctaacatcttccgcgggagctatctggccggagccggcctggctttctccctcatgaaatctcttgggggaggcagacgggggacaggagcccaaggcgagaccctgggcgagaagtggaagcgccagctgaatcagctcagcaaatccgaatttaacacatacaagagaagcgggattatggaggtcgatcggtccgaagcgaaagagggactgaagagaggcgaaacgaccaaacatgccgtgtctcgcgggacagctaaacttcggtggttcgtggagagaaatctggttaagcctgagggaaaagtcatcgacctcggctgtgggcgcggaggctggagctattactgcgccggcctgaagaaagtgaccgaagtgaaggggtatacaaaaggaggccccgggcacgaggaacctattcccatggctacctacggatggaacctggtcaagctccattccggcaaagatgtgtttttcatgcctccggagaagtgtgacacgcttctgtgcgatatcggggaatctagccccaatcctaccatcgaggagggacggacactgagagttctcaagatggtggaaccctggctgcgcggcaaccagttttgtattaaaatccttaatccttacatgccctccgtcgtggagaccctggaacaaatgcagcggaagcacggcgggatgctcgttagaaacccgctgtctcgcaatagcacacacgagatgtattgggtgtcctgcggaaccggcaacattgtcagcgccgtgaacatgacatctcggatgctgctcaatagattcaccatggcgcatcgcaaacctacgtacgagcgggacgttgatctgggggccggaacaagacacgtggctgtcgaacccgaggtggccaaccttgacatcattggccagcgcatcgaaaatattaagaacgagcataaatccacctggcactatgatgaagacaatccctacaagacctgggcttatcacgggagctacgaggtgaagccttctggatccgccagctctatggtcaacggcgttgtgagactgctcacaaaaccctgggatgtgatccctatggtcacgcaaatcgctatgaccgacacaaccccgtttggccagcagcgggtgttcaaggagaaagttgacacacgcacccccagagccaagcgggggacaacccagattatggaagtgacggcgaaatggctgtggggatttctttccagaaataagaagcctcggatctgtacccgcgaggagttcacaagaaaagtccggagcaacgccgctattggcgccgtgtttgttgatgagaatcaatggaactccgctaaggaagccgtggaggacgagcgcttctgggatctggtccatagagaacgggagctccacaaacaggggaagtgcgctacctgcgtgtataatatgatgggaaaacgcgaaaagaagctgggcgagtttgggaaagcgaagggcagcagagctatctggtacatgtggctgggagcccggttcctcgagttcgaggccctgggctttatgaacgaggaccattggttctctcgcgaaaatagcctttccggggttgagggagaaggcctgcacaaactcgggtacattctgagagatatctctaagatccccggaggcaacatgtatgctgacgatacagccgggtgggacacccggattacggaggatgaccttcagaatgaggctaaaatcacagaaattatggagcctgaacatgccctgctcgcgaccagcatctttaagctgacataccagaacaaagtggtccgcgtgcaaagacccgccaagaacggcaccgtcatggatgtgatttcccggcgcgaccagagaggatctggccaggttgggacgtatggactgaataccttcacaaacatggaggtgcagctcatccggcaaatggaaagcgagggcatctttctgccgtccgagcttgaaacccctaatctggctgagagagtcctcgattggctggaaaagcacggggccgagcgccttaaacggatggctatttctggagacgactgtgtggtgaagcccatcgatgacagattcgccacagcgctgaccgccctcaacgatatgggcaaagttcgcaaggacattcctcagtgggaacccagcaaagggtggaatgattggcaacaggtgcctttttgctcccaccatttccaccaactgatcatgaaggacggccgggagattgtcgtgccctgtagaaaccaggatgagctggttggacgcgctcgggtgagccagggcgccgggtggtctctcagagaaacagcttgcctgggaaagtcctacgcccaaatgtggcagcttatgtattttcatcgccgggacctgagactcgctgccaatgcgatctgtagcgccgtcccggtggattgggtccctacctctcgcacgacatggtccatccacgctcaccatcagtggatgaccaccgaggacatgctgagcgtgtggaaccgggtttggattgaagagaatccctggatggaagataaaacacacgtgtcctcttgggaggaggtcccctaccttggcaagagagaagaccagtggtgcgggagcctgatcggactcaccgcccgggccacatgggctacgaacattcaagtggccatcaatcaggttagacgcctgattggcaacgagaattatctggactacatgacctccatgaaacggttcaagaacgaaagcgatcctgagggggcgctctggtga

SEQ ID NO: 18625 - RNA, 9879 nt, synthetic construct
  misc_feature 1..9879: note = derived and/or modified CDS sequence (opt5) from DENV-1__GQ868522__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggatcaccctcctgagcctgacgtttatcaaaacaaccctttccctggattacgcttggaagaccacagccatggctctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggccattgggatcgtgagcatcctgctctcttccctgctcaagaatgacgtgcccctggcgggacctcttattgccggcgggatgctgatcgcttgttatgtcattagcggatccagcgccgatctgtctctcgagaaagctgccgaagtgagctgggagcaagaagccgagcattccggcacatctcacaacatcctggttgaagtgcaggacgatgggaccatgaagattaaagacgaggagcgcgatgacacgcttaccatcctgctcaaggctacactgctcgcggtcagcggagtgtaccccatgtccatccctgccaccctgtttgtttggtatttctggcagaaaaagaagcagagatctggcgtgctttgggatacacccagcccgcctgaagtcgagcgggctgtgctggacgatggcatttaccgcatcctgcaaagagggctcctgggacggtcccaggtcggcgtgggggttttccaggacggagtgtttcataccatgtggcacgtcacacgcggcgccgtgcttatgtatcaggggaaaagactggaaccctcttgggccagcgttaagaaagacctcatttcctacggaggcggctggcggttccaagggagctggaatacgggagaggaggtgcaggtcatcgctgtggaacctggcaagaaccccaaaaatgtgcagaccatgccggggacatttaagacccctgagggagaagttggcgccattgcgctggatttcaagcccgggacctctggatcccctatcgtcaacagagagggcaaaattgtgggcctctacgggaatggagtggtcacaacgagcggcacctatgtgtctgctatcgcccaagccaaggcttcccaggaagggcccctgcccgagatcgaggacgaagtttttaaaaagcgcaaccttacaattatggatctgcaccctggaagcggcaaaacccggagatacctgccggccatggtgcgcgaggcgatcaagcggaagctcagaacactgattcttgctcccacccgcgtcgtggcctccgaaatggccgaggctctgaaagggatgcctatccggtatcagacgacagccgttaagtctgaacataccggcagagagattgtggacctcatgtgccacgctaccttcacaatgcgcctgctgagccccgtccgggtgcctaattacaacatgatcatcatggatgaggcccattttaccgaccccgcgtccattgccgctagaggatatatcagcacacgggttggcatgggggaagccgctgccattttcatgaccgccacgcctccgggatctgtggaggcttttccccagtccaatgcggtcatccaagatgaagaacgcgacattcctgaaagaagctggaactctggctacgattggatcacagacttccccgggaaaaccgtgtggtttgtgcctagcatcaagtccggaaatgatattgccaactgtctccggaaaaacggcaagcgcgtcatccagctttctagaaagacattcgacaccgagtatcagaaaacgaagaataacgactgggattacgttgtgaccacagacattagcgagatgggggctaatttccgggccgatagagtgatcgacccccgccggtgcctgaaaccggtcattctgaaggatggccctgaaagagtgatcctcgccggacccatgcccgttaccgtggcttccgccgcgcagcgccggggcagaattgggcgcaaccaaaataaagagggagaccagtacgtctatatgggccagcctctgaacaatgatgaagaccacgctcattggacagaggccaagatgcttctggataacatcaatacccccgaggggatcattcctgccctctttgaaccggagcgggaaaagtctgctgccatcgacggagagtacagactgcgcggcgaagcgagaaaaacattcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgctcgcacgtattctgatcccctggcccttcgggagtttaaggagttcgctgccgggagacgctccgtcagcggagacctgatcctcgagattggcaaactgcctcagcacctgacactccgggctcagaatgcccttgataacctggtgatgctgcacaattccgaacaagggggaaaggcgtacagacatgccatggaggaactccccgacaccatcgagaccctgatgcttctggctctcatcgccgttctgacaggcggcgtgaccctgtttttcctctctgggaagggacttggcaaaacaagcattgggctgctgtgtgtgacggcttcctctgccctcctgtggatggccagcgtcgagccgcactggatcgctgcgtccattatccttgaatttttcctgatggttctcctgattcctgagcccgatcggcaacgcacccctcaggacaaccagctggcctatgtggtgatcggactcctttttatgatcctgacagtcgctgccaacgaaatgggcctgctcgagaccacaaagaaagatctggggattggacatgtggccgctgagaatcaccaacacgccaccatgcttgacgttgatctgagacccgcgagcgcctggacgctctacgctgtggccaccacagtcatcacccctatgatgcggcatacaattgaaaacaccacggctaatatctctctgacagccattgcgaaccaggccgctatcctgatgggcctcgacaagggctggcccatttccaaaatggatatcggggtgccgcttctggccctgggatgctacagccaggtcaatcctctcaccctgacagctgccgtgcttatgctggttgctcactatgccatcattggccccgggctccaggcgaaggccacccgcgaggctcaaaagagaaccgccgctggaatcatgaaaaaccccacagtggacggcattgtcgccatcgatctggaccctgtggtttacgacgccaagttcgaaaaacagctggggcagattatgctccttatcctgtgtacgtctcagatcctgctcatgcggaccacatgggcgctgtgcgagtccattacccttgctacaggaccgctgaccacgctctgggaaggcagccccggcaagttttggaatacaaccatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacctacaagagaagcgggatcatggaggtcgatcggtccgaagcgaaagagggactgaagagaggcgaaacaacgaaacatgccgtgtctcgcgggaccgctaaacttcggtggttcgtggagagaaatctggttaagcctgagggaaaagtcattgacctcggctgtgggcgcggaggctggagctattactgcgccggcctgaagaaagtgacagaagtgaaggggtataccaaaggaggccccgggcacgaggaacctatccccatggctacatacggatggaacctggtcaagctccattccggcaaagatgtgtttttcatgcctccggagaagtgtgacacccttctgtgcgatatcggggaatctagccccaatcctacgattgaggagggacggaccctgagagttctcaagatggtggaaccctggctgcgcggcaaccagttttgtatcaaaattcttaatccttacatgccctccgtcgtggagacactggaacaaatgcagcggaagcacggcgggatgctcgttagaaacccgctgtctcgcaatagcacccacgagatgtattgggtgtcctgcggaacaggcaacatcgtcagcgccgtgaacatgacctctcggatgctgctcaatagattcacaatggcgcatcgcaaacctacctacgagcgggacgttgatctgggggccggaacgagacacgtggctgtcgaacccgaggtggccaaccttgacattatcggccagcgcattgaaaatatcaagaacgagcataaatccacatggcactatgatgaagacaatccctacaagacctgggcttatcacgggagctacgaggtgaagccttctggatccgccagctctatggtcaacggcgttgtgagactgctcaccaaaccctgggatgtgatccctatggtcacacaaattgctatgacggacaccacaccgtttggccagcagcgggtgttcaaggagaaagttgacacccgcacacccagagccaagcgggggaccacacagatcatggaagtgaccgcgaaatggctgtggggatttctttccagaaataagaagcctcggatttgtacgcgcgaggagttcaccagaaaagtccggagcaacgccgctatcggcgccgtgtttgttgatgagaatcaatggaactccgctaaggaagccgtggaggacgagcgcttctgggatctggtccatagagaacgggagctccacaaacaggggaagtgcgccacatgcgtgtataatatgatgggaaaacgcgaaaagaagctgggcgagtttgggaaagcgaagggcagcagagctatttggtacatgtggctgggagcccggttcctcgagttcgaggccctgggctttatgaacgaggaccattggttctctcgcgaaaatagcctttccggggttgagggagaaggcctgcacaaactcgggtacatcctgagagatatctctaagattcccggaggcaacatgtatgctgacgataccgccgggtgggacacacggatcaccgaggatgaccttcagaatgaggctaaaattacggaaatcatggagcctgaacatgccctgctcgcgacaagcatttttaagctgacctaccagaacaaagtggtccgcgtgcaaagacccgccaagaacggcacagtcatggatgtgatctcccggcgcgaccagagaggatctggccaggttgggacctatggactgaatacgttcaccaacatggaggtgcagctcatccggcaaatggaaagcgagggcatttttctgccgtccgagcttgaaacacctaatctggctgagagagtcctcgattggctggaaaagcacggggccgagcgccttaaacggatggctatctctggagacgactgtgtggtgaagcccattgatgacagattcgccaccgcgctgacagccctcaacgatatgggcaaagttcgcaaggacatccctcagtgggaacccagcaaagggtggaatgattggcagcaggctcctttttgctcccaccatttccaccaactgattatgaaggacggccgggagatcgtggtcccctgtagaaaccaggatgagctggtgggacgcgcccgggttagccagggcgctgggtggtctctcagagaaaccgcctgcctgggaaagtcctacgctcaaatgtggcagcttatgtattttcatcgccgggacctgagactcgccgcgaatgccatctgtagcgctgtgccggtcgattgggtgcctacatctcgcaccacgtggtccattcacgcccaccatcagtggatgacaaccgaggacatgctgagcgtctggaaccgggtgtggatcgaagagaatccctggatggaagataaaacccacgtttcctcttgggaggaggtgccctaccttggcaagagagaagaccagtggtgcgggagcctgattggactcacagcccgggctacctgggccacaaacatccaagtcgcgattaatcaggtgagacgcctgatcggcaacgagaattatctggactacatgacgtccatgaaacggttcaagaacgaaagcgatcctgagggggctctctggtga

SEQ ID NO: 18626 - RNA, 9879 nt, synthetic construct
  misc_feature 1..9879: note = derived and/or modified CDS sequence (opt5) from DENV-1__HQ166036__SS-prME
  source 1..9879: mol_type = other RNA
agcgtgaccatgctgctcatgctgcttcccacagctctggctttccacctcacgacccggggcggggaacctcatatgatcgtctccaagcaggaacggggaaagtctctgctttttaagacaagcgccggcgttaacatgtgcaccctgattgcgatggacctcggggaactgtgtgaagatacaatgacctacaaatgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaagctgccgaagtgagctgggagcaagaagccgagcattccggcacctctcacaacattctggttgaagtgcaggacgatgggacgatgaagatcaaagacgaggagcgcgatgacacccttacaattctgctcaaggctaccctgctcgcggtcagcggagtgtaccccatgtccatccctgccacactgtttgtttggtatttctggcagaaaaagaagcagagatctggcgtgctttgggatacccccagcccgcctgaagtcgagcgggctgtgctggacgatggcatctaccgcattctgcaaagagggctcctgggacggtcccaggtcggcgtgggggttttccaggacggagtgtttcatacaatgtggcacgtcacgcgcggcgccgtgcttatgtatcaggggaaaagactggaaccctcttgggccagcgttaagaaagacctcatctcctacggaggcggctggcggttcagagggagctggaataccggagaggaggtgcaagtcattgctgtggaacctggcaagaaccccaaaaatgtgcagacaaccccggggacctttaagacacctgagggagaagttggcgccatcgcgctggatttcaagcccgggacgtctggatcccctattgtcaaccgcgagggcaaaatcgtgggcctctacgggaatggagtggtcaccacaagcggcacctatgtgtctgctattgcccaggccaaggcttcccaagaagggcccctgcccgagatcgaggacgaagtttttaaaaagcggaaccttacaatcatggatctgcaccctggaagcggcaaaaccagacgctacctgccggccattgtgcgggaggcgatcaagagaaagctccgcacgctgattcttgctcccacacgggtcgtggcctccgaaatggccgaggctctgaaagggatgcctatcagatatcagaccaccgccgttaagtctgaacatacaggccgcgagattgtggacctcatgtgccacgctaccttcacaatgcggctgctgagccccgtcagagtgcctaattacaacatgatcatcatggatgaggcccattttaccgaccccgcgtccattgccgctcggggatatatcagcacgcgcgttggcatgggggaagccgctgccattttcatgacagccacccctccgggatctgtggaggcttttccccagtccaatgcggtcatccaggatgaagagagagacattcctgaacggagctggaactctggctacgattggatcacagacttccccgggaaaaccgtgtggtttgtgcctagcatcaagtccggaaatgatattgccaactgtctccgcaaaaacggcaagagagtcatccaactttctcggaagacgttcgacaccgagtatcagaaaacaaagaataacgactgggattacgttgtgaccacagacattagcgagatgggggctaatttcagagccgatcgcgtgatcgacccccggagatgcctgaaaccggtcattctgaaggatggccctgaacgcgtgatcctcgccggacccatgcccgttaccgtggcttccgccgcgcagcggagaggccgcattgggcggaaccagaataaagagggagaccaatacgtctatatgggccagcctctgaacaatgatgaagaccacgctcattggacagaggccaagatgcttctggataacatcaatacccccgaggggatcattcctgccctctttgaaccggagagagaaaagtctgctgccatcgacggagagtaccgcctgagaggcgaagcgcggaaaacgttcgtggagctgatgcgcagaggggatctccccgtttggcttagctataaggtggcctccgagggctttcagtacagcgaccggcgctggtgcttcgatggagaaagaaacaatcaggtcctggaggaaaacatggacgtggagatttggacaaaagaaggcgagcggaagaaactgagacctcgctggctcgacgctcggacctattctgatcccctggcccttagagagtttaaggagttcgctgccgggcgccggtccgtcagcggagacctgatcctcgagattggcaaactgcctcaacacctgacctccagagctcagaatgccctcgataaccttgtgatgctgcacaattctgaacaagggggaaaggcgtaccggcatgccatggaggaactgcccgacacaatcgagaccctcatgctgcttgctctgatcgccgttctcacaggcggcgtgacgctgtttttcctgagcgggaagggactcggcaaaacctccattgggcttctgtgtgtgacagcttctagcgccctgctctggatggcctccgtcgagccgcactggatcgctgcgagcattatcctggaatttttccttatggttctgctcattcctgagcccgatcgccagagaacccctcaagacaaccagctggcctatgtggtgatcggactgctctttatgatccttacagtcgctgccaacgaaatgggcctgctggagaccacgaagaaagatctcgggattggacatgtggccgctgagaatcaccagcacgccaccatgctggacgttgatcttcggcccgcgtctgcctggacactgtacgctgtggccaccacagtcatcacccctatgatgcgccatacgattgaaaacacaaccgctaatatctccctcacagccattgcgaaccaagccgctatcctgatgggcctggacaagggctggcccattagcaaaatggatatcggggtgccgctccttgccctgggatgctactctcaggtcaatcctctgaccctcaccgctgccgtgctgatgcttgttgctcactatgccatcattggccccgggctgcaggcgaaggccacaagagaggctcagaagcggacggccgctggaatcatgaaaaaccccaccgtggacggcattgtcgccatcgatctcgaccctgtggtttacgacgccaagttcgaaaaacaactggggcagattatgctgctcatcctttgtacatcccagatcctgctgatgcgcaccacatgggcgctctgcgagagcattaccctggctacgggaccgcttacaaccctgtgggaaggctctcccggcaagttttggaataccacaatcgccgtgagcatggctaacattttcagagggtcctatctcgccggagccggcctggctttctctctgatgaaaagcctcgggggaggccggcgcgggaccggagcccagggcgagacacttggcgagaagtggaagagacaactgaatcagctgtccaaaagcgaatttaacacgtacaagcggtccgggatcatggaggtcgatagatctgaagcgaaagagggactcaagcgcggcgaaaccacaaaacatgccgtgagccgggggaccgctaagctgagatggttcgtggagcgcaatcttgttaagcctgagggaaaagtcattgacctgggctgtgggcggggaggctggtcctattactgcgccggcctcaagaaagtgacagaagtgaaggggtataccaaaggaggccccgggcacgaggaacctatccccatggctacgtacggatggaacctggtcaagctgcattctggcaaagatgtgtttttcatgcctccggagaagtgtgacaccctcctttgcgatatcggggaaagctcccccaatcctacaattgaggagggaagaaccctgcgcgttctgaagatggtggaaccctggctccggggcaaccagttttgtatcaaaattctgaatccttacatgccctctgtcgtggagacacttgaacagatgcaaagaaagcacggcgggatgctggttcgcaacccgctcagcagaaattccacccacgagatgtattgggtgagctgcggaacaggcaacatcgtctctgccgtgaacatgacctccagaatgctgctgaatcgcttcacgatggcgcatcggaaacctacatacgagagagacgttgatctcggggccggaacccgccacgtggctgtcgaacccgaggtggccaacctggacattatcggccagagaattgaaaatatcaagaacgagcataaaagcacctggcactatgatgaagacaatccctacaagacatgggcttatcacgggtcttacgaggtgaagccttccggaagcgcctcttccatggtcaacggcgttgtgcggcttctgacgaaaccctgggatgtgatccctatggtcacccagattgctatgacagacaccacaccgtttggccaacagcgcgtgttcaaggagaaagttgacaccagaacaccccgggccaagagagggaccacgcagatcatggaagtgaccgcgaaatggctctggggatttctgagccggaataagaagcctcgcatttgtacaagagaggagttcacccggaaagtccgctccaacgccgctatcggcgccgtgtttgttgatgagaatcagtggaacagcgctaaggaagccgtggaggacgagagattctgggatcttgtccatcgggaacgcgagctgcacaaacaagggaagtgcgccacatgcgtgtataatatgatgggaaaaagagaaaagaagctcggcgagtttgggaaagcgaagggctctcgggctatttggtacatgtggctgggagcccgcttcctggagttcgaggccctcggctttatgaacgaggaccattggttcagcagagaaaattccctgtctggggttgagggagaaggccttcacaaactggggtacatcctccgggatatcagcaagattcccggaggcaacatgtatgctgacgataccgccgggtgggacacgcgcatcacagaggatgacctgcagaatgaggctaaaattaccgaaatcatggagcctgaacatgcccttctggcgacatccatttttaagctcacctaccagaacaaagtggtcagagtgcagcggcccgccaagaacggcacggtcatggatgtgatctctcgcagagaccaacggggaagcggccaggttgggacctatggactgaatacattcaccaacatggaggtgcagctgatcagacagatggaatccgagggcatttttctcccgtctgagctggaaacacctaatcttgctgagcgcgtcctggattggctcgaaaagcacggggccgagcggctgaaaagaatggctatcagcggagacgactgtgtggtgaagcccattgatgaccgcttcgccaccgcgcttacagccctgaacgatatgggcaaagttcggaaggacatccctcaatgggaaccctccaaagggtggaatgattggcaacaggtgcctttttgcagccaccatttccaccagctcattatgaaggacggcagagagatcgtcgtgccctgtcgcaaccaagatgagctggttggacgggctagagtgtctcagggcgccgggtggtccctgcgcgaaaccgcttgcctcggaaagagctacgcccagatgtggcaactgatgtattttcatcggagagaccttcgcctggctgccaatgcgatctgttctgccgtcccggtggattgggtccctacgtcccggacaacctggagcattcacgctcaccatcagtggatgaccacagaggacatgctctccgtgtggaacagagtttggatcgaagagaatccctggatggaagataaaacccacgtgtctagctgggaggaggtcccctacctgggcaagcgggaagaccagtggtgcgggtcccttattggactgacagccagagccacgtgggctaccaacatccaggtggccattaatcaagttcgccggctcatcggcaacgagaattatctggactacatgacaagcatgaaaagattcaagaacgaatctgatcctgagggggcgctgtggtga

SEQ ID NO: 18627 - RNA, 9879 nt, synthetic construct
  misc_feature 1..9879: note = derived and/or modified CDS sequence (opt5) from DENV-1__GU131981__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattatggtgggggccggagaaaaagccctgaagctgagctggttcaagaaaggctctagcatcgggaagatgtttgaggctaccgcccggggcgctagacgcatggccattctcggagacacagcgtgggatttcggctccatcgggggagtttttacctctgtcggcaaactggtgcatcaggtgttcgggacggcctacggagtcctttttagcggcgtgtcctggaccatgaagatcgggattggcatcctgctcacatggctgggactgaatagccggtctacctcccttagcatgacatgtattgctgttggcatggtgaccctctacctgggggtcatggtgcaagccgactctggatgcgttatcaactggaaaggcagagaactgaagtgtgggtccggaattttcgtgacaaacgaggtccacacctggacggaacagtataagtttcaggctgatagccctaaacgcctctccgccgcgatcggcaaggcctgggaggagggggtgtgcggcattcggtctgctacaagactggaaaatatcatgtggaaacagatcagcaacgagcttaatcatattctgctcgaaaacgacatgaagttcaccgttgtggtcggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtgcatgccgatatgggctattggatcgaatctgagaaaaacgaaacatggaagctggcccgggcttccttcatcgaggtcaagacctgtacatggcccaaaagccacaccctgtggtctaatggggttctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtggtcgacgagcactgcggaaatcgcggcccctctctgcggacaaccacggtgacaggcaagattatccatgaatggtgttgcagaagctgtaccctgcctccccttcggttccgcggggaggatggatgctggtacggcatggagatcagaccggttaaagaaaaggaggaaaacctcgtgcggtccatggtcagcgcggggtctggagaggtggactcctttagcctgggcattctgtgtgcttccatcatgattgaagaggttatgagatctcgctggagccggaagatgctcatgacagggaccctggccgtgttccttctgctcgtcatgggacaactgacctggaatgacctgatcagactttgcattatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccatcggcctgagcctggtcgcctccgtggaacttcccaactctctggaggaactcggggacggactggccatgggcattatgatgctcaagctgcttacagagttccagccccaccagctgtggatcaccctcctgagcctgacgtttatcaaaacaaccctttccctggattacgcttggaagaccacagccatggctctcagcattgtgtctctgttccctctctgtctgtccaccacaagccagaaaacgacctggcttccggtcctgctggggtcttttggatgcaagcccctcacaatgttcctgatcaccgaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacatctcacaacatcctggtggaagttcaggacgatgggaccatgaagattaaagacgaggagcgcgatgacacgcttaccatcctgctcaaggctacactgctcgcggtgagcggagtctaccccatgtccatccctgccaccctgtttgtgtggtatttctggcagaaaaagaagcagagatctggcgttctttgggatacacccagcccgcctgaagtggagcgggctgtcctggacgatggcatttaccgcatcctgcaaagagggctcctgggacggtcccaggtgggcgtcggggtgttccaggacggagtttttcataccatgtggcacgtgacacgcggcgccgtccttatgtatcaggggaaaagactggaaccctcttgggccagcgtgaagaaagacctcatttcctacggaggcggctggcggttccaagggagctggaatacgggagaggaggttcaggtgatcgctgtcgaacctggcaagaaccccaaaaatgtgcagaccatgccggggacatttaagacccctgagggagaagtgggcgccattgcgctggatttcaagcccgggacctctggatcccctatcgttaacagagagggcaaaattgtcggcctctacgggaatggagtggtgacaacgagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatggttcgcgaggcgatcaagcggaagctcagaacactgattcttgctcccacccgcgtggtcgcctccgaaatggccgaggctctgaaagggatgcctatccggtatcagacgacagccgtgaagtctgaacataccggcagagagattgttgacctcatgtgccacgctaccttcacaatgcgcctgctgagccccgtgcgggtccctaattacaacatgatcatcatggatgaggcccattttaccgaccccgcgtccattgccgctagaggatatatcagcacacgggtgggcatgggggaagccgctgccattttcatgaccgccacgcctccgggatctgttgaggcttttccccagtccaatgcggtgatccaagatgaagagcgcgacattcctgaaagaagctggaactctggctacgattggatcacagacttccccgggaaaaccgtctggtttgtgcctagcatcaagtccggaaatgatattgccaactgtctccggaaaaacggcaagcgcgtgatccagctttctagaaagacattcgacaccgagtatcagaaaacgaagaataacgactgggattacgtcgttaccacagacattagcgagatgggggctaatttccgggccgatagagtgatcgacccccgccggtgcctgaaaccggtgattctgaaggatggccctgaaagagtcatcctcgccggacccatgcccgtgaccgttgcttccgccgcgcagcgccggggcagaattgggcgcaaccaaaataaagagggagaccagtacgtgtatatgggccagcctctgaacaatgatgaagaccacgctcattggacagaggccaagatgcttctggataacatcaatacccccgaggggatcattcctgccctctttgaaccggagcgggaaaagtctgctgccatcgacggagagtacagactgcgcggcgaagcgagaaaaacattcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatttggaccaaagaaggcgagagaaagaaactgcggcctagatggctcgacgctcgcacgtattctgatcccctggcccttcgggagtttaaggaattcgctgccgggagacgctccgtgagcggagacctgatcctcgagattggcaaactgcctcagcacctgacactccgggctcagaatgcccttgataacctggtcatgctgcacaattccgaacaggggggaaaggcgtacagacatgccatggaggaactccccgacaccatcgagaccctgatgcttctggctctcatcgccgtgctgacaggcggcgttaccctgtttttcctctctgggaagggacttggcaaaacaagcattgggctgctgtgtgtgacggcttcctctgccctcctgtggatggccagcgtggagccgcactggatcgctgcgtccattatccttgaatttttcctgatggtcctcctgattcctgagcccgatcggcaacgcacccctcaggacaaccagctggcctatgttgtgatcggactcctttttatgatcctgacagtggctgccaacgaaatgggcctgctcgagaccacaaagaaagatctggggattggacatgtcgccgctgagaatcaccaacacgccaccatgcttgacgtggatctgagacccgcgagcgcctggacgctctacgctgttgccaccacagtgatcacccctatgatgcggcatacaattgaaaacaccacggctaatatctctctgacagccattgcgaaccaggccgctatcctgatgggcctcgacaagggctggcccatttccaaaatggatatcggggtcccgcttctggccctgggatgctacagccaggtgaatcctctcaccctgacagctgccgtccttatgctggtggctcactatgccatcattggccccgggctccaggcgaaggccacccgcgaggctcaaaagagaaccgccgctggaatcatgaaaaaccccacagttgacggcattgtggccatcgatctggaccctgtcgtgtacgacgccaagttcgaaaaacagctggggcagattatgctccttatcctgtgtacgtctcagatcctgctcatgcggaccacatgggcgctgtgcgagtccattacccttgctacaggaccgctgaccacgctctgggaaggcagccccggcaagttttggaatacaaccatcgccgtttctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacctacaagagaagcgggatcatggaggtggatcggtccgaagcgaaagagggactgaagagaggcgaaacaacgaaacatgccgtctctcgcgggaccgctaagcttcggtggttcgtggagagaaatctggtgaagcctgagggaaaagttattgacctcggctgtgggcgcggaggctggagctattactgcgccggcctgaagaaagtcacagaagtgaaggggtataccaaaggaggccccgggcacgaggaacctatccccatggctacatacggatggaacctggtgaagctccattccggcaaagatgtctttttcatgcctccggagaagtgtgacacccttctgtgcgatatcggggaatctagccccaatcctacgattgaggagggacggaccctgagagttctcaagatggtggaaccctggctgcgcggcaaccagttttgtatcaaaattcttaatccttacatgccctccgtggtcgagacactggaacaaatgcagcggaagcacggcgggatgctcgtgagaaacccgctgtctcgcaatagcacccacgagatgtattgggtttcctgcggaacaggcaacatcgtgagcgccgtcaacatgacctctcggatgctgctcaatagattcacaatggcgcatcgcaaacctacctacgagcgggacgtggatctgggggccggaacgagacacgttgctgtggaacccgaggtcgccaaccttgacattatcggccagcgcattgaaaatatcaagaacgagcataaatccacatggcactatgatgaagacaatccctacaagacctgggcttatcacgggagctacgaggtgaagccttctggatccgccagctctatggtgaacggcgtcgttagactgctcaccaaaccctgggatgtgatccctatggtgacacaaattgctatgacggacaccacaccgtttggccagcagcgggtcttcaaggagaaagtggacacccgcacacccagagccaagcgggggaccacacagatcatggaagttaccgcgaaatggctgtggggatttctttccagaaataagaagcctcggatttgtacgcgcgaggaattcaccagaaaagtgcggagcaacgccgctatcggcgccgtctttgtggatgagaatcaatggaactccgctaaggaagccgttgaggacgagcgcttctgggatctggtgcatagagaacgggagctccacaaacaggggaagtgcgccacatgcgtctataatatgatgggaaaacgcgaaaagaagctgggcgagtttgggaaagcgaagggcagcagagctatttggtacatgtggctgggagcccggttcctcgaattcgaggccctgggctttatgaacgaggaccattggttctctcgcgaaaatagcctttccggggtggagggagaaggcctgcacaaactcgggtacatcctgagagatatctctaagattcccggaggcaacatgtatgctgacgataccgccgggtgggacacacggatcaccgaggatgaccttcagaatgaggctaaaattacggaaatcatggagcctgaacatgccctgctcgcgacaagcatttttaagctgacctaccagaacaaagttgtgcgcgtccaaagacccgccaagaacggcacagtgatggatgtcatctcccggcgcgaccagagaggatctggccaggtggggacctatggactgaatacgttcaccaacatggaggttcagctcatccggcaaatggaaagcgagggcatttttctgccgtccgagcttgaaacacctaatctggctgagagagtgctcgattggctggaaaagcacggggccgagcgccttaaacggatggctatctctggagacgactgtgtcgtgaagcccattgatgacagattcgccaccgcgctgacagccctcaacgatatgggcaaagtgcgcaaggacatccctcagtgggaacccagcaaagggtggaatgattggcagcaggttcctttttgctcccaccatttccaccaactgattatgaaggacggccgggagatcgtggtcccctgtagaaaccaggatgagctggtgggacgcgctcgggttagccagggcgccgggtggtctctcagagaaaccgcttgcctgggaaagtcctacgcccaaatgtggcagcttatgtattttcatcgccgggacctgagactcgctgccaatgcgatctgtagcgccgtgccggtcgattgggtgcctacatctcgcaccacgtggtccattcacgctcaccatcagtggatgacaaccgaggacatgctgagcgtctggaaccgggtgtggatcgaagagaatccctggatggaagataaaacccacgtttcctcttgggaggaggtgccctaccttggcaagagagaagaccagtggtgcgggagcctgattggactcacagcccgggccacctgggctacaaacatccaagtcgccattaatcaggtgagacgcctgatcggcaacgagaattatctggactacatgacgtccatgaaacggttcaagaacgaaagcgatcctgagggggcgctctggtga

SEQ ID NO: 18628 - RNA, 9879 nt, synthetic construct
  misc_feature 1..9879: note = derived and/or modified CDS sequence (opt5) from DENV-1__GQ868529__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgcctttttcctggcgcatgccattgggacatctatcacccaaaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaagaataaacccacactggatatcgaactgctcaagaccgaggtcacaaaccctgccattctgcggaaactttgcatcgaagcgaagatttctaataccacgacagactcccgctgtccgacccagggagaggccaccctggttgaagagcaggatgctaactttgtgtgcagacggacattcgtggaccgcggctggggcaatgggtgtggactctttggcaaagggagcctgcttacctgcgccaagttcaagtgcgtcacaaaactggagggaaagacggtgcagtacgaaaacctcaaatattctgttatcgtgaccgtccacacaggcgatcaacatcaggtggggaatgagaccacagaacacggaaccatcgctacgattaccccccaggcccctacatccgagatccagctgaccgactacggcgccctgacactcgactgtagccccagaaccggcctggattttaacgaaatggttcttctgacgatgaaggagaaatcttggctcgtgcataagcaatggttcctggaccttcctctgccctggacatccggggctagcacctcccaggagacatggaatcggcaggatctcctggtcacctttaaaaccgcgcacgccaagaagcaagaagtggtcgtgctgggatctcaggagggcgctatgcacacagccctcacgggggccaccgaaattcagacaagcggaaccacaaccatcttcgctggccatctgaaatgccgccttaagatggacaaactgacgctcaaggggacatcctatgttatgtgtaccggcagcttcaaactggagaaggaagtggccgagacccagcacggaacagtcctggtgcaagttaagtacgagggcaccgatgcgccgtgcaaaattcctttttctacacaggacgaaaagggggtgacgcagaacggaagacttatcaccgctaatcccatcgtcacagataaagagaagcctgtgaacattgaaaccgagccccccttcggcgagtcctatatcgtggttggggccggagaaaaagccctcaagctgagctggtttaagaaaggctctagcattgggaagatgttcgaggctacagcccggggcgctagacgcatggccatcctgggagacaccgcgtgggattttggctccattgggggagtcttcacgtctgtgggcaaactcgtgcatcaggtctttgggaccgcctacggagtgctgttcagcggcgtttcctggacaatgaagatcgggatcggcattcttctgacctggctcggactgaatagccggtctacatccctgagcatgacctgtatcgctgtgggcatggtcacactttacctcggggtgatggttcaagccgactctggatgcgtgattaactggaaaggcagagaactgaagtgtgggtccggaatctttgtcaccaacgaggtgcacacgtggacagaacagtataagttccaggctgatagccctaaacgcctgtccgccgcgattggcaaggcctgggaggagggggtttgcggcatccggtctgctaccagactcgaaaatattatgtggaaacagatcagcaacgagctgaatcatatccttctggaaaacgacatgaagtttaccgtggtcgtgggagacgccaatggcattctcgctcaagggaaaaagatgatccgcccgcagcccatggagcacaaatactcctggaagtcttggggaaaggccaaaattatcggcgccgatattcagaacacaaccttcatcatcgacgggcctgatacgcccgaatgtcctgacaatcagcgggcttggaacatttgggaggtggaggattatggatttggcatcttcacaaccaatatttggctgaagctgagagacagctacacacaaatgtgcgatcaccgccttatgtccgcggccatcaaagacagcaaggctgtccatgccgatatgggctattggattgaatctgagaaaaacgaaacctggaagctcgcccgggcttccttcatcgaggttaagacatgtacctggcccaaaagccacacgctgtggtctaatggggtgctggaatccgagatgatcattccgaagatctacggaggccctattagccagcataactatagacccgggtactttacccagatcgccggaccttggcacctcggcaaactggagcttgacttcgatctgtgcgaagggacaaccgtggtcgtggacgagcactgcggaaatcgcggcccctctctccggacaaccacggttacaggcaagattatccatgaatggtgttgcagaagctgtaccctgcctcccctgcggtttcgcggggaggatggatgctggtacggcatggagatcagaccggtgaaagaaaaggaggaaaaccttgtccggtccatggtgagcgcggggtctggagaggttgactccttcagcctcggcattctgtgtgcttccatcatgattgaagaggtgatgagatctcgctggagccggaagatgctgatgacagggaccctcgccgtctttctgcttctggtgatgggacaactcacctggaatgacctgatcagactgtgcattatggttggcgccaacgcttccgatcgcatgggcatggggacaacgtatcttgccctgatggcgaccttcaaaatgagacctatgtttgctgtgggactcctgttccggcgcctcacatctagagaggtcctgcttctgaccatcggcctcagcctggtggcctccgtggaactgcccaactctcttgaggaactgggggacggactcgccatgggcattatgatgctgaagctcctgacagagtttcagccccaccagctttggaccacgctgctcagcctgacattcatcaaaaccaccctgtcccttgattacgcttggaagacaaccgccatggctctgagcatcgtctctctctttcctctgtgtctctccacaacgagccagaaaaccacatggctgccggttcttctggggtctttcggatgcaagcccctgaccatgtttctcattacagaaaataagatctggggccggaaatcctggcctctgaacgagggcattatggccatcgggattgtgagcatccttctgtcttccctcctgaagaatgacgtgcccctcgcgggacctctgatcgccggcgggatgcttattgcttgttatgtcatcagcggatccagcgccgatctgtctctggagaaagctgccgaagtgagctgggagcaagaagccgagcattccggcacctctcacaacattctcgttgaagtgcaggacgatgggacgatgaagatcaaagacgaggagcgcgatgacaccctgacaattcttctgaaggctaccctcctggcggtcagcggagtgtaccccatgtccatccctgccacactcttcgtttggtatttctggcagaaaaagaagcagagatctggcgtgctgtgggatacccccagcccgcctgaagtcgagcgggctgtgcttgacgatggcatctaccgcattctgcaaagagggctgctcggacggtcccaggtcggcgtgggggtttttcaggacggagtgttccatacaatgtggcacgtcacgcgcggcgccgtgctgatgtatcaggggaaaagacttgaaccctcttgggccagcgttaagaaagacctgatctcctacggaggcggctggcggtttcaagggagctggaataccggagaggaggtgcaggtcattgctgtggaacctggcaagaaccccaaaaatgtgcagacaaccccggggaccttcaagacacctgagggagaagttggcgccatcgcgctcgattttaagcccgggacgtctggatcccctattgtcaacagagagggcaaaatcgtgggcctgtacgggaatggagtggtcaccacaagcggcacctatgtgtctgctattgcccaagccaaggcttcccaggaagggcccctccccgagatcgaggacgaagttttcaaaaagcgcaacctgacaatcatggatcttcaccctggaagcggcaaaacccggagatacctgccggccatggtgcgcgaggcgattaagcggaagctgagaacgctcatcctggctcccacacgcgtcgtggcctccgaaatggccgaggctcttaaagggatgcctattcggtatcagaccaccgccgttaagtctgaacatacaggcagagagatcgtggacctgatgtgccacgctacctttacaatgcgcctcctgagccccgtccgggtgcctaattacaacatgattatcatggatgaggcccatttcaccgaccccgcgtccatcgccgctagaggatatattagcacgcgggttggcatgggggaagccgctgccatctttatgacagccacccctccgggatctgtggaggctttcccccagtccaatgcggtcattcaagatgaagagcgcgacatccctgaaagaagctggaactctggctacgattggattacagactttcccgggaaaaccgtgtggttcgtgcctagcatcaagtccggaaatgatatcgccaactgtctgcggaaaaacggcaagcgcgtcattcagctctctagaaagacgttcgacaccgagtatcagaaaacaaagaataacgactgggattacgttgtgaccacagacatcagcgagatgggggctaattttcgggccgatagagtgattgacccccgccggtgccttaaaccggtcatcctgaaggatggccctgaaagagtgattctggccggacccatgcccgttaccgtggcttccgccgcgcagcgccggggcagaatcgggcgcaaccaaaataaagagggagaccagtacgtctatatgggccagcctctcaacaatgatgaagaccacgctcattggacagaggccaagatgctgcttgataacattaatacccccgaggggatcatccctgccctgttcgaaccggagcgggaaaagtctgctgccattgacggagagtacagactccgcggcgaagcgagaaaaacgtttgtggagctgatgcggcgcggggatctgcccgtttggctcagctataaggtggcctccgagggcttccagtacagcgacagacggtggtgctttgatggagaacgcaacaatcaagtccttgaggaaaacatggacgtggagatctggacaaaagaaggcgagagaaagaaactgcggcctagatggctggacgctcgcacctattctgatcccctcgccctgcgggagttcaaggaatttgctgccgggagacgctccgtcagcggagaccttatgctggagattggcaaactccctcagcacctgaccctgcgggctcagaatgccctcgataaccttgtgatgctgcacaattccgaacaggggggaaaggcgtacagacatgccatggaggaactgcccgacacaatcgagaccctcatgctgcttgctctgattgccgttctcacaggcggcgtgacgctgttctttctgtctgggaagggactcggcaaaaccagcatcgggcttctgtgtgtgacagcttcctctgccctgctctggatggccagcgtcgagccgcactggatcgctgcgtccattatcctggaattctttcttatggttctgctcattcctgagcccgatcggcaacgcacccctcaggacaaccagctggcctatgtggtgatcggactgctcttcatgattcttacagtcgctgccaacgaaatgggcctgctggagaccacgaagaaagatctcgggatcggacatgtggccgctgagaatcaccaacacgccaccatgctggacgttgatcttagacccgcgagcgcctggacactgtacgctgtggccaccacagtcatcacccctatgatgcggcatacgattgaaaacacaaccgctaatatctctctcacagccattgcgaaccaggccgctatcctgatgggcctggacaagggctggcccatttccaaaatggatatcggggtgccgctccttgccctgggatgctacagccaggtcaatcctctgaccctcaccgctgccgtgctgatgcttgttgctcactatgccattatcggccccgggctgcaggcgaaggccacacgcgaggctcaaaagagaacggccgctggaatcatgaaaaaccccaccgtggacggcattgtcgccatcgatctcgaccctgtggtttacgacgccaagtttgaaaaacagctggggcagattatgctgctcatcctttgtacatctcagattctgctgatgcggaccacatgggcgctctgcgagtccatcaccctggctacgggaccgcttacaaccctgtgggaaggcagccccggcaagttctggaataccacaatcgccgtgtctatggctaacattttccgcgggagctatctcgccggagccggcctggctttttccctgatgaaatctctcgggggaggcagacgggggaccggagcccaaggcgagacacttggcgagaagtggaagcgccagctgaatcagctgagcaaatccgaattcaacacgtacaagagaagcgggatcatggaggtcgatcggtccgaagcgaaagagggactcaagagaggcgaaaccacaaaacatgccgtgtctcgcgggaccgctaagctgcggtggtttgtggagagaaatcttgttaagcctgagggaaaagtcattgacctgggctgtgggcgcggaggctggagctattactgcgccggcctcaagaaagtgacagaagtgaaggggtataccaaaggaggcctggggcacgaggatcccatccctatggctacgtacggatggaacctggtcaagctccttgccggcaaagacgttttctttatgccccctgaaaagtgtgataccctgctgtgcgacattggggagtcctctccgaatcccacaatcgaagagggacggaccctcagagtgctgaagatggtggagccttggcttcgcggcaaccagttctgtatcaaaattctgaatccctacatgcctagcgtcgtggaaacactcgagcaaatgcagcggaagcatggcgggatgctggttagaaaccccctgtcccgcaattctacccacgaaatgtattgggtgagctgcggaacaggcaacatcgtctccgcggtgaacatgaccagccggatgctcctgaatagatttacgatggcccaccgcaaaccgacatacgagcgggatgttgaccttggggctggaaccagacatgtggccgtcgagcctgaagtggctaacctggatattatcggccagcgcattgagaatatcaagaacgaacacaaatctacctggcattatgacgaggataatccctacaagacatgggcctatcacgggtcctacgaagtgaagcccagcggatctgcttccagcatggtcaacggcgttgtgagactcctgacgaaaccttgggacgtgattcccatggtcacccaaatcgccatgacagacaccacacctttcggccagcagcgggtgtttaaggagaaagttgatacccgcacaccgagagcgaagcgggggaccacgcagatcatggaggtgaccgccaaatggctttggggattcctgtctagaaataagaagccccggatttgtacacgcgaagagtttaccagaaaagtccggtccaacgctgccatcggcgctgtgttcgttgacgaaaatcaatggaacagcgccaaggaggccgtggaagatgagcgcttttgggacctcgtccacagagagcgggaactgcataaacaggggaagtgcgcgacatgcgtgtataatatgatgggaaaacgcgagaagaagctgggcgaattcgggaaagctaagggctccagagccatttggtacatgtggctcggagcccggttcctggagtttgaagctcttggcttcatgaacgaggatcactggtttagccgcgagaattctctgagcggggttgaaggagagggcctccataaactggggtacatccttagagacatttccaagatccctggaggcaacatgtatgccgatgacaccgctgggtgggatacgcggatcacagaagacgatctgcagaatgaggccaaaattaccgagatcatggaacccgagcacgcgctcctggccacatctattttcaagctgacctaccagaacaaagtggtccgcgtgcaaagacctgctaagaacggcacggtcatggacgtgatcagccggcgcgatcagagaggatccggccaggttgggacctatggactcaatacatttaccaacatggaagtgcagctgattcggcaaatggagtctgaaggcatcttccttcccagcgagctggagacaccgaatctcgccgaaagagtcctggactggcttgagaagcatggggctgaacgcctgaaacggatggccatctccggagacgattgtgtggtgaagcctattgacgatagatttgcgaccgccctcacagctctgaacgacatgggcaaagttcgcaaggatatcccccagtgggagccttctaaagggtggaatgactggcagcaggtgcccttctgcagccaccactttcatcaactgattatgaaggatggccgggaaatcgtcgtgccttgtagaaaccaggacgagctcgttggacgcgcccgggtgtcccagggcgctgggtggagcctgagagagaccgcctgccttggaaagtcttacgctcaaatgtggcagctgatgtatttccaccgccgggatctcagactggccgcgaatgccatttgttccgctgtccccgtggactgggtcccgacgagccgcacaacctggtctatccatgcccaccaccagtggatgaccacagaagatatgctttccgtgtggaaccgggtttggatcgaggaaaatccttggatggaggacaaaacccatgtgagctcctgggaagaggtcccctacctgggcaagagagaggaccagtggtgcgggtctctcattggactgacagcccgggctacgtgggccaccaacatccaagtggcgattaatcaggttagacgcctgatcggcaacgaaaattatctcgattacatgacaagcatgaaacggtttaagaacgagtccgaccccgaaggggctctgtggtga

SEQ ID NO: 18629 - RNA, 9879 nt, synthetic construct
  misc_feature 1..9879: note = derived and/or modified CDS sequence (opt5) from DENV-1__GQ868531__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagtctgaacatacaggcagagagattgtcgacctcatgtgccacgccaccttcacaatgcgcctgctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctccggaaaaacggcaagcgcgttatccagctttctagaaagacgttcgacaccgagtatcagaaaacaaagaataacgactgggattacgtggtgaccacagacattagcgagatgggggccaatttccgggctgatagagtcatcgacccccgccggtgcctgaaaccggtgattctgaaggatggccctgaaagagttatcctcgccggacccatgcccgtgaccgtcgcctccgctgcccagcgccggggcagaattgggcgcaaccaaaataaagagggagaccagtacgtgtatatgggccagcctctgaacaatgatgaagaccacgcgcattggacagaggctaagatgcttctggataacatcaatacccccgaggggatcattcctgccctctttgaaccggagcgggaaaagtctgccgctatcgacggagagtacagactgcgcggcgaagccagaaaaacgttcgttgagctgatgcggcgcggggatctccccgtgtggcttagctataaggtcgcgtccgagggctttcagtacagcgacagacggtggtgcttcgatggagaacgcaacaatcaagtgctggaggaaaacatggacgtcgagatttggacaaaagaaggcgagagaaagaaactgcggcctagatggctcgacgcccgcacctattctgatcccctggctcttcgggagtttaaggaattcgccgctgggagacgctccgtgagcggagacctgatcctcgagattggcaaactgcctcagcacctgaccctccgggcccagaatgctcttgataacctggttatgctgcacaattccgaacaggggggaaaggcctacagacatgcgatggaggaactccccgacacaatcgagaccctgatgcttctggccctcatcgctgtgctgacaggcggcgtgacgctgtttttcctctctgggaagggacttggcaaaaccagcattgggctgctgtgtgtcacagcctcctctgctctcctgtggatggccagcgttgagccgcactggatcgccgcttccattatccttgaatttttcctgatggtgctcctgattcctgagcccgatcggcaacgcacccctcaggacaaccagctggcgtatgtggtcatcggactcctttttatgatcctgacagtggccgctaacgaaatgggcctgctcgagaccacgaagaaagatctggggattggacatgttgccgccgagaatcaccaacacgctaccatgcttgacgtggatctgagacccgccagcgcgtggacactctacgccgtcgctaccacagtgatcacccctatgatgcggcatacgattgaaaacacaaccgccaatatctctctgacagctattgccaaccaggcggccatcctgatgggcctcgacaagggctggcccatttccaaaatggatatcggggtcccgcttctggctctgggatgctacagccaggtgaatcctctcaccctgaccgccgctgttcttatgctggtggcccactatgctatcattggccccgggctccaggccaaggcgacacgcgaggcccaaaagagaacggctgccggaatcatgaaaaaccccaccgtcgacggcattgtggctatcgatctggaccctgttgtgtacgacgccaagttcgaaaaacagctggggcagattatgctccttatcctgtgtacatctcagatcctgctcatgcggaccacatgggccctgtgcgagtccattacccttgcgacgggaccgctgacaaccctctgggaaggcagccccggcaagttttggaataccacaatcgctgtctctatggccaacattttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggatcatggaggtggatcggtccgaagccaaagagggactgaagagaggcgaaaccacaaaacatgcggtgtctcgcgggaccgccaagcttcggtggttcgttgagagaaatctggtcaagcctgagggaaaagtgattgacctcggctgtgggcgcggaggctggagctattactgcgctggcctgaagaaagtgacagaagtcaaggggtataccaaaggaggccccgggcacgaggaacctatccccatggccacgtacggatggaacctggttaagctccattccggcaaagatgtgtttttcatgcctccggagaagtgtgacacccttctgtgcgatatcggggaatctagccccaatcctacaattgaggagggacggaccctgagagtgctcaagatggtcgaaccctggctgcgcggcaaccagttttgtatcaaaattcttaatccttacatgccctccgtggttgaggctctggaacaaatgcagcggaagcacggcgggatgctcgtgagaaacccgctgtctcgcaatagcacacacgagatgtattgggtctcctgcggaaccggcaacatcgtgagcgccgttaacatgacatctcggatgctgctcaatagattcaccatggcgcatcgcaaacctacgtacgagcgggacgtggatctgggggccggaacaagacacgtcgctgtggaacccgaggtggccaaccttgacattatcggccagcgcattgaaaatatcaagaacgagcataaatccacctggcactatgatgaagacaatccctacaagacctgggcttatcacgggagctacgaggtcaagccttctggatccgccagctctatggttaacggcgtggtgagactgctcacaaaaccctgggatgtcatccctatggtgacgcaaattgctatgaccgacacaaccccgtttggccagcagcgggttttcaaggagaaagtggacacacgcacccccagagccaagcgggggacaacccagatcatggaagtcacggcgaaatggctgtggggatttctttccagaaataagaagcctcggatttgtacccgcgaggaattcacaagaaaagtgcggagcaacgccgctatcggcgccgtttttgtggatgagaatcaatggaactccgctaaggaagccgtcgaggacgagcgcttctgggatctggtgcatagagaacgggagctccacaaacaggggaagtgcgccacctgcgtttataatatgatgggaaaacgcgaaaagaagctgggcgagtttgggaaagcgaagggcagcagagctatttggtacatgtggctgggagcccggttcctcgaattcgaggccctgggctttatgaacgaggaccattggttctctcgcgaaaatagcctttccggggtggagggagaaggcctgcacaaactcgggtacatcctgagagatatctctaagattcccggaggcaacatgtatgctgacgatacagccgggtgggacacccggatcacggaggatgaccttcagaatgaggctaaaattacagaaatcatggagcctgaacatgccctgctcgcgaccagcatttttaagctgacataccagaacaaagtcgtgcgcgtccaaagacccgccaagaacggcaccgtgatggatgttatctcccggcgcgaccagagaggatctggccaggtggggacgtatggactgaataccttcacaaacatggaggtccagctcatccggcaaatggaaagcgagggcatttttctgccgtccgagcttgaaacccctaatctggctgagagagtgctcgattggctggaaaagcacggggccgagcgccttaaacggatggctatctctggagacgactgtgtggttaagcccattgatgacagattcgccacagcgctgaccgccctcaacgatatgggcaaagtgcgcaaggacatccctcagtgggaacccagcaaagggtggaatgattggcagcaggtccctttttgctcccaccatttccaccaactgattatgaaggacggccgggagatcgtggttccctgtagaaaccaggatgagctggtgggacgcgctcgggtcagccagggcgccgggtggtctctcagagaaacagcttgcctgggaaagtcctacgcccaaatgtggcagcttatgtattttcatcgccgggacctgagactcgctgccaatgcgatcagctctgccgtgccggtcgattgggtgcctacctcccgcacgacatggagcattcacgctcaccatcagtggatgaccaccgaggacatgctgtccgtttggaaccgggtgtggatcgaagagaatccctggatggaagataaaacacacgtctctagctgggaggaggtgccctaccttggcaagagagaagaccagtggtgtgggtccctgattggactcaccgcccgggccacatgggctacgaacatccaagttgccattaatcaggtgagacgcctgatcggcaacgagaattatctggactacatgaccagcatgaaacggttcaagaacgaatctgatcctgagggggcgctctggtga

SEQ ID NO: 18630 - RNA, 9879 nt, synthetic construct
  misc_feature 1..9879: note = derived and/or modified CDS sequence (opt5) from DENV-1__GU131983__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgatcgggacactggccgtcttccttctgctcgtgatgggacaactgacctggaatgacctgattagactttgcatcatggttggcgccaacgcttccgatcgcatgggcatggggaccacatatctggccctcatggcgacgtttaaaatgagacctatgttcgctgtgggactgctctttcggcgcctgacctctagagaggtccttctgctcacaattggcctgagcctggtggcctccgtggaacttcccaactctctggaggaactcggggacggactggccatgggcatcatgatgctcaagctgcttaccgagttccagccccaccagctgtggacaaccctcctgagcctgacgtttatcaaaacaaccctttccctggattacgcttggaagaccacagccatggctctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggccattgggatcgtgagcatcctgctctcttccctgctcaagaatgacgtgcccctggcgggacctcttattgccggcgggatgctgatcgcttgttatgtcattagcggatccagcgccgatctgtctctcgagaaagctgccgaagtgagctgggagcaagaagccgagcattccggcacatctcacaacatcctggttgaagtgcaggacgatgggaccatgaagattaaagacgaggagcgcgatgacacgcttaccatcctgctcaaggctacactgctcgcggtcagcggagtgtaccccatgtccatccctgccaccctgtttgtttggtatttctggcagaaaaagaagcagagatctggcgtgctttgggatacacccagcccgcctgaagtcgagcgggctgtgctggacgatggcatttaccgcatcctgcaaagagggctcctgggacggtcccaggtcggcgtgggggttttccaggacggagtgtttcataccatgtggcacgtcacacgcggcgccgtgcttatgtatcaggggaaaagactggaaccctcttgggccagcgttaagaaagacctcatttcctacggaggcggctggcggttccaagggagctggaatacgggagaggaggtgcaggtcatcgctgtggaacctggcaagaaccccaaaaatgtgcagaccacaccggggacctttaagacccctgagggagaagttggcgccattgcgctggatttcaagcccgggacatctggatcccctatcgtcaacagagagggcaaaattgtgggcctctacgggaatggagtggtcacgaccagcggcacatatgtgtctgctatcgcccaagccaaggcttcccaggaagggcccctgcccgagatcgaggacgaagtttttaaaaagcgcaaccttaccattatggatctgcaccctggaagcggcaaaacacggagatacctgccggccatcgtgcgcgaggcgattaagcggaagctcagaaccctgatccttgctcccacgcgcgtcgtggcctccgaaatggccgaggctctgaaagggatgcctattcggtatcagacaaccgccgttaagtctgaacataccggcagagagatcgtggacctcatgtgccacgctacattcaccatgcgcctgctgagccccgtccgggtgcctaattacaacatgatcattatggatgaggcccattttacagaccccgcgtccatcgccgctagaggatatattagcacccgggttggcatgggggaagccgctgccatcttcatgacggccacacctccgggatctgtggaggcttttccccagtccaatgcggtcattcaagatgaagaacgcgacatccctgaaagaagctggaactctggctacgattggatcaccgacttccccgggaaaacagtgtggtttgtgcctagcattaagtccggaaatgatatcgccaactgtctccggaaaaacggcaagcgcgtcattcagctttctagaaagaccttcgacacggagtatcagaaaaccaagaataacgactgggattacgttgtgacaaccgacatcagcgagatgggggctaatttccgggccgatagagtgattgacccccgccggtgcctgaaaccggtcatcctgaaggatggccctgaaagagtgattctcgccggacccatgcccgttacagtggcttccgccgcgcagcgccggggcagaatcgggcgcaaccaaaataaagagggagaccagtacgtctatatgggccagcctctgaacaatgatgaagaccacgctcattggaccgaggccaagatgcttctggataacatcaatacacccgaggggattatccctgccctctttgaaccggagcgggaaaagtctgctgccattgacggagagtacagactgcgcggcgaagcgagaaaaaccttcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatctggacgaaagaaggcgagagaaagaaactgcggcctagatggctcgacgctcgcacatattctgatcccctggcccttcgggagtttaaggagttcgctgccgggagacgctccgtcagcggagacctgattctcgagatcggcaaactgcctcagcacctgaccctccgggctcagaatgcccttgataacctggtgatgctgcacaattccgaacaagggggaaaggcgtacagacatgccatggaggaactccccgacaccatcgagacactgatgcttctggctctcattgccgttctgaccggcggcgtgacactgtttttcctctctgggaagggacttggcaaaacgagcatcgggctgctgtgtgtgaccgcttcctctgccctcctgtggatggccagcgtcgagccgcactggattgctgcgtccatcattcttgaatttttcctgatggttctcctgatccctgagcccgatcggcaacgcacacctcaggacaaccagctggcctatgtggtgatcggactcctttttatgattctgaccgtcgctgccaacgaaatgggcctgctcgagacaaccaagaaagatctggggatcggacatgtggccgctgagaatcaccaacacgccacgatgcttgacgttgatctgagacccgcgagcgcctggaccctctacgctgtggccacaaccgtcattacacctatgatgcggcataccatcgaaaacacgacagctaatatttctctgaccgccatcgcgaaccaggccgctattctgatgggcctcgacaagggctggcccatctccaaaatggatatcggggtgccgcttctggccctgggatgctacagccaggtcaatcctctcacactgaccgctgccgtgcttatgctggttgctcactatgccattatcggccccgggctccaggcgaaggccacccgcgaggctcaaaagagaacagccgctggaattatgaaaaaccccacggtggacggcatcgtcgccattgatctggaccctgtggtttacgacgccaagttcgaaaaacagctggggcagatcatgctccttatcctgtgtacctctcagattctgctcatgcggacaacctgggcgctgtgcgagtccatcacacttgctaccggaccgctgacgacactctgggaaggcagccccggcaagttttggaataccaccattgccgtgtctatggctaacatcttccgcgggagctatctggccggagccggcctggctttctccctcatgaaatctcttgggggaggcagacgggggacaggagcccaaggcgagaccctgggcgagaagtggaagcgccagctgaatcagctcagcaaatccgaatttaacacatacaagagaagcgggattatggaggtcgatcggtccgaagcgaaagagggactgaagagaggcgaaacgaccaaacatgccgtgtctcgcgggacagctaaacttcggtggttcgtggagagaaatctggttaagcctgagggaaaagtcatcgacctcggctgtgggcgcggaggctggagctattactgcgccggcctgaagaaagtgaccgaagtgaaggggtatacaaaaggaggccccgggcacgaggaacctatccccatggctacctacggatggaacctggtcaagctccattccggcaaagatgtgtttttcatgcctccggagaagtgtgacacgcttctgtgcgatattggggaatctagccccaatcctaccatcgaggagggacggacactgagagttctcaagatggtggaaccctggctgcgcggcaaccagttttgtattaaaatccttaatccttacatgccctccgtcgtggagaccctggaacaaatgcagcggaagcacggcgggatgctcgttagaaacccgctgtctcgcaatagcacacacgagatgtattgggtgtcctgcggaaccggcaacattgtcagcgccgtgaacatgacatctcggatgctgctcaatagattcaccatggcgcatcgcaaacctacgtacgagcgggacgttgatctgggggccggaacaagacacgtggctgtcgaacccgaggtggccaaccttgacatcattggccagcgcatcgaaaatatcaagaacgagcataaatccacctggcactatgatgaagacaatccctacaagacctgggcttatcacgggagctacgaggtgaagccttctggatccgccagctctatggtcaacggcgttgtgagactgctcacaaaaccctgggatgtgattcctatggtcacgcaaatcgctatgaccgacacaaccccgtttggccagcagcgggtgttcaaggagaaagttgacacacgcacccccagagccaagcgggggacaacccagattatggaagtgacggcgaaatggctgtggggatttctttccagaaataagaagcctcggatctgtacccgcgaggagttcacaagaaaagtccggagcaacgccgctattggcgccgtgtttgttgatgagaatcaatggaactccgctaaggaagccgtggaggacgagcgcttctgggatctggtccatagagaacgggagctccacaaacaggggaagtgcgctacctgcgtgtataatatgatgggaaaacgcgaaaagaagctgggcgagtttgggaaagcgaagggcagcagagctatctggtacatgtggctgggagcccggttcctcgagttcgaggccctgggctttatgaacgaggaccattggttctctcgcgaaaatagcctttccggggttgagggagaaggcctgcacaaactcgggtacatcctgagagatatttctaagatccccggaggcaacatgtatgctgacgatacagccgggtgggacacccggattacggaggatgaccttcagaatgaggctaaaatcacagaaattatggagcctgaacatgccctgctcgcgaccagcatctttaagctgacataccagaacaaagtggtccgcgtgcaaagacccgccaagaacggcaccgtcatggatgtgatctcccggcgcgaccagagaggatctggccaggttgggacgtatggactgaataccttcacaaacatggaggtgcagctcattcggcaaatggaaagcgaggagatctttctgccgtccgaacttgagacccctaatctggctgaaagagtcctcgattggctggagaagcacggcgccgaacgccttaaacggatggctatttctggggacgactgtgtggtgaagcccatcgatgacagattcgccacagcgctgaccgccctcaacgatatgggaaaagttcgcaaggacattcctcagtgggagcccagcaaaggctggaatgattggcaacaggtgcctttttgctcccaccatttccaccaactgatcatgaaggacgggcgggagatcgtcgtgccctgtagaaaccaggatgaactggttggccgcgctcgggtgagccagggagccggctggtctctcagagagacagcttgcctggggaagtcctacgcccaaatgtggcagcttatgtattttcatcgccgggacctgagactcgctgccaatgcgatttgtagcgccgtcccggtggattgggtccctacctctcgcacgacatggtccatccacgctcaccatcagtggatgaccaccgaagacatgctgagcgtgtggaaccgggtttggattgaggaaaatccctggatggaggataaaacacacgtgtcctcttgggaggaagtcccctaccttggaaagagagaggaccagtggtgcggcagcctgatcgggctcaccgcccgggccacatgggctacgaacattcaagtggccatcaatcaggttagacgcctgattggaaacgaaaattatctggactacatgacctccatgaaacggttcaagaacgagagcgatcctgagggcgcgctctggtga

SEQ ID NO: 18631 - RNA, 9879 nt, synthetic construct
  misc_feature 1..9879: note = derived and/or modified CDS sequence (opt5) from DENV-1__GQ868532__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtcccacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcgtgatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggatcaccctcctgagcctgacgtttatcaaaacaaccctttccctggattacgcttggaagaccacagccatggctctcagcattgtctctctgttccctctctgtctgtccaccacaagccagaaaacgacctggcttccggttctgctggggtcttttggatgcaagcccctcacaatgttcctgatcaccgaaaataagatttggggccggaaatcctggcctcttaacgagggcatcatggccattgggatcgtgagcatcctgctctcttccctgctcaagaatgacgtgcccctggcgggacctcttattgccggcgggatgctgatcgcttgttatgtcattagcggaaactccgccgatctgagcctcgagaaagctgccgaagtgtcttgggagcaagaagccgagcatagcggcacatcccacaatatcctggttgaagtgcaggacgatgggaccatgaagattaaagacgaggagcgcgatgacacgcttaccatcctgctcaaggctacactgctcgcggtctctggagtgtaccccatgagcatccctgccaccctgtttgtttggtatttctggcagaaaaagaagcagagatccggcgtgctttgggatacaccctctccgcctgaagtcgagcgggctgtgctggacgatggcatttaccgcatcctgcaaagagggctcctgggacggagccaggtcggcgtgggggttttccaggacggagtgtttcataccatgtggcacgtcacacgcggcgccgtgcttatgtatcaggggaaaagactggaaccctcctgggcctctgttaagaaagacctcattagctacggaggcggctggcggttccaagggtcctggaacacgggagaggaggtgcaggtcatcgctgtggaacctggcaagaatcccaaaaacgtgcagaccatgccggggacatttaagacccctgagggagaagttggcgccattgcgctggatttcaagcccgggaccagcggatctcctatcgtcaatagagagggcaaaattgtgggcctctacgggaacggagtggtcacaacgtccggcacctatgtgagcgctatcgcccaagccaaggcttctcaggaagggccgccccctgagatcgaggacgaagtttttaaaaagcgcaatctgacaattatggatcttcacccgggatccggcaaaacccggagatacctgcccgccatggtgcgcgaggcgatcaagcggaagctgagaacactcattctggctcctacccgcgtcgtggccagcgaaatggccgaggctcttaaagggatgcccatccggtatcagacgacagccgttaagtccgaacataccggcagagagattgtggacctgatgtgccacgctaccttcacaatgcgcctcctgtctcctgtccgggtgcccaactacaatatgatcatcatggatgaggcccattttaccgaccctgcgagcattgccgctagaggatatatctccacacgggttggcatgggggaagccgctgccattttcatgaccgccacgccgcccggaagcgtggaggcttttcctcagtctaacgcggtcatccaagatgaagaacgcgacattcccgaaagatcctggaatagcggctacgattggatcacagacttccctgggaaaaccgtgtggtttgtgccctctatcaagagcggaaacgatattgccaactgtctgcggaaaaatggcaagcgcgtcatccagctctccagaaagacattcgacaccgagtatcagaaaacgaagaacaatgactgggattacgttgtgaccacagacatttctgagatgggggctaacttccgggccgatagagtgatcgacccgcgccggtgccttaaacctgtcattctgaaggatggccccgaaagagtgatcctggccggacccatgcctgttaccgtggctagcgccgcgcagcgccggggcagaattgggcgcaatcaaaacaaagagggagaccagtacgtctatatgggccagcccctcaataacgatgaagaccacgctcattggacagaggccaagatgctgcttgataatatcaacacccctgaggggatcattccggccctgtttgaacccgagcgggaaaagtccgctgccatcgacggagagtacagactccgcggcgaagcgagaaaaacattcgtggagctgatgcggcgcggggatctgcctgtttggctctcttataaggtggccagcgagggctttcagtactccgacagacggtggtgcttcgatggagaacgcaataaccaagtccttgaggaaaatatggacgtggagatttggaccaaagaaggcgagagaaagaaactgcggcccagatggctggacgctcgcacgtatagcgatcctctcgccctgcgggagtttaaggagttcgctgccgggagacgctctgtctccggagaccttatcctggagattggcaaactcccccagcacctgacactgcgggctcagaacgccctcgataatcttgtgatgctgcacaacagcgaacaaggcgggaaggcgtacagacatgccatggaggaactgccggacaccatcgagaccctcatgctgcttacactgatcgctgttctcaccgggggcgtgacactgtttttcctgtccgggaagggactcggcaaaacgtctattgggcttctgtgtgtgaccgccagctccgctctgctctggatggcctctgtcgagcctcactggatcgccgctagcattatcctggaatttttccttatggttctgctcattcccgagcctgatcggcaacgcacaccccaggacaaccagctggcgtatgtggtgatcggactgctctttatgatccttaccgtcgccgctaatgaaatgggcctgctggagacaaccaagaaagatctcgggattggacatgtggccgccgagaaccaccaacacgctacgatgctggacgttgatcttagacctgcctccgcgtggaccctgtacgccgtggctacaaccgtcatcacacccatgatgcggcataccattgaaaatacgacagccaacatcagcctcaccgctattgccaatcaggcggccatcctgatgggcctggacaagggctggccgatttctaaaatggatatcggggtgcctctccttgctctgggatgctactcccaggtcaaccccctgacactcaccgccgctgtgctgatgcttgttgcccactatgctatcattggccccgggctgcaggccaaggcgacccgcgaggcccaaaagagaacagctgccggaatcatgaaaaatcctacggtggacggcattgtcgctatcgatctcgacccggtggtttacgacgccaagttcgaaaaacagctggggcagattatgctgctcatcctttgtaccagccagatcctgctgatgcggacaacctgggccctctgcgagtctattacactggcgaccggaccccttacgacactgtgggaaggctcccctggcaagttttggaacaccaccatcgctgtgagcatggccaatattttccgcgggtcttatctcgctggagccggcctggccttcagcctgatgaaatccctcgggggaggcagacgggggacaggagctcaaggcgagacccttggcgagaagtggaagcgccagctgaaccagctgtctaaaagcgaatttaatacatacaagagatccgggatcatggaggtcgatcggagcgaagccaaagagggactcaagagaggcgaaacgaccaaacatgcggtgtcccgcgggacagccaagctgcggtggttcgtggagagaaaccttgttaagcccgagggaaaagtcattgacctgggctgtgggcgcggaggctggtcttattactgcgctggcctcaagaaagtgaccgaagtgaaggggtatacaaaaggaggccctgggcacgaggaacccatccctatggccacctacggatggaatctggtcaagctgcatagcggcaaagatgtgtttttcatgccgcccgagaagtgtgacacgctcctttgcgatatcggggaatcctctcctaaccccaccattgaggagggacggacactgagagttctgaagatggtggaaccttggctccgcggcaatcagttttgtatcaaaattctgaacccctacatgccgaatgtcgtggagacccttgaacaaatgcagcggaagcacggcgggatgctggttagaaaccctctcagccgcaactccacacacgagatgtattgggtgtcttgcggaaccggcaatatcgtcagcgctgtgaacatgacatcccggatgctgctgaatagattcaccatggcccatcgcaaacccacgtacgagcgggacgttgatctcggggcgggaacaagacacgtggccgtcgaacccgaggtggctaacctggacattatcggccagcgcattgaaaatatcaagaacgagcataaaagcacctggcactatgatgaagacaatccttacaagacctgggcctatcacgggtcttacgaggtgaagccctccggaagcgcttcttccatggtcaacggcgttgtgagacttctgacaaaaccttgggatggcatcccgatggtgacgcaaattgccatgaccgacacaaccccctttgggcagcagcgggtcttcaaggagaaagtggacacacgcacccctagagctaagcggggaacaacccagatcatggaagttacggccaaatggctctggggctttctgagcagaaataagaagccccggatttgtacccgcgaggagttcacaagaaaagtgcggtctaacgcggccatcggggctgtctttgtggatgagaatcaatggaactccgccaaggaagctgttgaggacgagcgcttctgggatcttgtgcatagagaacgggagctgcacaaacagggaaagtgcgctacctgcgtctataatatgatgggcaaacgcgaaaagaagctcggggagtttggcaaagccaagggaagcagagcgatttggtacatgtggctgggcgctcggttcctggagttcgaggccctcgggtttatgaacgaggaccattggttctcccgcgaaaatagcctgtctggagtggagggcgaagggcttcacaaactgggatacatcctcagagatatcagcaagattcctggcgggaacatgtatgccgacgatacagctggctgggacacccggatcacggaggatgacctgcagaacgaggccaaaattacagaaatcatggagcccgaacatgcccttctggccacctccatttttaagctcacataccagaataaagttgtgcgcgtccaaagaccggcgaagaacggaaccgtgatggatgtcatctctcggcgcgaccagagaggcagcggacaggtgggaacgtatggcctgaataccttcacaaacatggaggttcagctgatccggcaaatggaatccgaggggatttttctcccttctgagctggaaacccccaatcttgccgagagagtgctggattggctcgaaaagcacggagctgagcgcctgaaacggatggccatcagcggcgacgactgtgtcgtgaagcctattgatgacagattcgctacagcccttaccgcgctgaacgatatggggaaagtgcgcaaggacatcccccagtgggaaccttccaaaggctggaatgattggcagcaggttcccttttgctctcaccatttccaccaactcattatgaaggacggacgggagatcgtggtcccgtgtagaaaccaggatgagctggtgggccgcgcccgggttagccagggggctggatggtccctgagagaaacagcctgcctcggcaagagctacgctcaaatgtggcagctgatgtattttcatcgccgggaccttagactggccgctaatgccatctgttctgcggtgcctgtcgattgggtgcccacctcccgcacgacatggagcattcacgcccaccatcagtggatgaccaccgaggacatgctctctgtctggaaccgggtgtggatcgaagagaatccctggatggaagataaaacacacgtttccagctgggaggaggtgccttacctggggaagagagaagaccagtggtgcggatcccttattggcctgaccgctcgggccacatgggccacgaacatccaagtcgctattaatcaggtgagacgcctcatcgggaacgagaattatctggactacatgacctctatgaaacggttcaagaacgaaagcgatccggagggcgccctgtggtga

SEQ ID NO: 18632 - RNA, 9879 nt, synthetic construct
  misc_feature 1..9879: note = derived and/or modified CDS sequence (opt5) from DENV-1__GQ868533__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattgaagccgatatccagaacaccacatttatcattgacggccctgatacccccgagtgtcctgacaatcagcgggcttggaacatctgggaggtggaagattatgggttcggaatttttacgacaaatatctggctgaagcttagagacagctacacccaaatgtgcgatcaccgcctcatgtccgcggccattaaagacagcaaggctgtccatgccgatatgggctattggatcgagtctgaaaaaaacgagacatggaagctggcccgggcttccttcatcgaagttaagacctgtacatggcccaaaagccacaccctgtggtctaatggcgtgctcgagtccgagatgattatcccgaagatttacgggggacctatcagccagcataactatagacccggctacttcacgcagaccgccgggccttggcacctgggaaaacttgaactggactttgatctctgcgagggcacaaccgtggtcgtggacgaacactgcgggaatcgcggaccctctctgcggacaaccacggttacaggcaagattatccatgagtggtgttgcagaagctgtaccctgcctccccttcggttccgcggcgaggatgggtgctggtacggaatggaaatcagaccggtgaaagagaaggaagagaacctcgtccggtccatggtgagcgcgggctctggggaagttgactcctttagcctgggaattctgtgtgcttccatcatgattgaggaggtgatgagatctcgctggagccggaagatgctcatgacaggcaccctggccgtcttccttctgctcgtgatggggcaactgacctggaatgacctgatcagactttgcattatggttggagccaacgcttccgatcgcatgggcatgggcacaacgtatctggccctcatggcgacctttaaaatgagacctatgttcgctgtggggctgctctttcggcgcctgacatctagagaagtccttctgctcaccatcggactgagcctggtggcctccgtggagcttcccaactctctggaagagctcggcgacgggctggccatgggaattatgatgctcaagctgcttacagaattccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctgggctcttttgggtgcaagcccctcaccatgttcctgattacagagaataagatctggggacggaaatcctggcctcttaacgagggcattatggccatcggcattgtgagcatcctgctctcttccctgctcaagaatgacgtgcccctggcggggcctcttatcgccggaggcatgctgattgcttgttatgtcatcagcgggtccagcgccgatctgtctctcgaaaaagctgccgaggtgagctgggaacaagaggccgaacattccggaacctctcacaacattctggttgaggtgcaggacgatggcacgatgaagatcaaagacgaggaacgcgatgacacccttacaattctgctcaaggctaccctgctcgcggtcagcggggtgtaccccatgtccatccctgccacactgtttctttggtatttctggcagaaaaagaagcagagatctggagttctgtgggatacccccagcccgcctgaggtggaacgggctgtcctggacgatggcatctaccgcattctccaaagaggcctgcttgggcggtcccaggtgggagtcggcgtgttccaggacggggtttttcatacaatgtggcacgtgacgcgcggagccgtcctgatgtatcagggcaaaagactcgagccctcttgggccagcgtgaagaaagacctgatctcctacgggggaggctggcggttccaaggcagctggaataccggggaggaagttcaggtgattgctgtcgagcctggaaagaaccccaaaaatgtgcagacaaccccgggcacctttaagacacctgaaggggaggtgggagccatcgcgctcgatttcaagcccggcacgtctgggtcccctattgttaacagagaaggaaaaatcgtcggcctgtacggcaatggggtggtgaccacaagcggaacctatgtctctgctattgcccaagccaaggcttcccaggagggcccccttcccgagatcgaagacgaggtgtttaaaaagcgcaacctgacaatcatggatctgcaccctgggagcggaaaaacccggagatacctcccggccattgttcgcgaagcgatcaagcggaagctgagaacgcttattctggctcccacacgcgtggtcgcctccgagatggccgaagctctcaaaggcatgcctatccggtatcagaccaccgccgtgaagtctgagcatacagggagagagattgttgacctgatgtgccacgctaccttcacaatgcgcctgctcagccccgtgcgggtccctaattacaacatgatcatcatggatgaagcccattttaccgaccccgcgtccattgccgctagaggctatatcagcacgcgggtgggaatgggcgaggccgctgccattttcatgacagccacccctccggggtctgttgaagcttttccccagtccaatgcggtgatccaagatgaggaacgcgacattcctgagagaagctggaactctggatacgattggatcacagacttccccggcaaaaccgtctggtttgtgcctagcatcaagtccgggaatgatattgccaactgtcttcggaaaaacggaaagcgcgtgatccagctgtctagaaagacgttcgacaccgagtatcagaaaacaaagaataacgactgggattacgtcgttaccacagacattagcgaaatgggcgctaatttccgggccgatagagtgatcgacccccgccggtgcctgaaaccggtgattctcaaggatgggcctgagagagtcatcctggccggccccatgcccgtgaccgttgcttccgccgcgcagcgccggggaagaattggccgcaaccaaaataaagaaggggaccagtacgtgtatatgggacagcctcttaacaatgatgaggaccacgctcattggacagaggccaagatgctgctcgataacatcaatacccccgaaggcatcattcctgccctgtttgagccggaacgggagaagtctgctgccatcgacggggaatacagactgcgcggagaggcgagaaaaacgttcgtcgagctcatgcggcgcggcgatcttcccgtgtggctgagctataaggttgcctccgaagggtttcagtacagcgacagacggtggtgcttcgatggcgagcgcaacaatcaagtgctggaagagaacatggacgtcgaaatttggacaaaagagggagagagaaagaaactccggcctagatggctggacgctcgcacctattctgatccccttgccctgcgggaatttaaggagttcgctgccggcagacgctccgtgagcggggacctcatcctggaaattggaaaactgcctcagcacctcacctcccgggctcagaatgcccttgataacctggtcatgctgcacaattctgagcagggcgggaaggcgtacagacatgccatggaagagctccccgacacaatcgagaccctgatgcttctggctctcatcgccgtgctgacaggaggcgttacgctgtttttcctcagcggcaaggggcttggaaaaacctccattggcctgctgtgtgtgacagcttctagcgccctcctgtggatggcctccgtggaaccgcactggatcgctgcgagcattatccttgagtttttcctgatggtcctcctgattcctgaacccgatcggcaacgcacccctcaggacaaccagctggcctatgttgtgatcgggctcctttttatgatcctgacagtggctgccaacgagatgggactgctcgagaccacgaagaaagatctgggcattgggcatgtcgccgctgaaaatcaccaacacgccaccatgcttgacgtggatctgagacccgcgtctgcctggacactctacgctgttgccaccacagtgatcacccctatgatgcggcatacgattgagaacacaaccgctaatatctccctgacagccattgcgaaccaggccgctatcctgatgggactcgacaagggctggcccattagcaaaatggatatcggcgtcccgcttctggccctggggtgctactctcaggtgaatcctctcaccctgaccgctgccgtccttatgctggtggctcactatgccatcattggacccggcctccaggcgaaggccacacgcgaagctcaaaagagaacggccgctgggatcatgaaaaaccccaccgttgacggaattgtggccatcgatctggaccctgtcgtgtacgacgccaagttcgagaaacagctgggccagattatgctccttatcctgtgtacatcccagatcctgctcatgcggaccacatgggcgctgtgcgaaagcattacccttgctacggggccgctgacaaccctctgggagggatctcccggcaagttttggaataccacaatcgccgttagcatggctaacattttccgcggctcctatctggccggggccggactggctttctctctcatgaaaagccttggcgggggaagacggggcaccggggcccaaggagagacactgggcgaaaagtggaagcgccagctgaatcagctctccaaaagcgagtttaacacgtacaagagatccggcatcatggaagtggatcggtctgaggcgaaagaagggctgaagagaggagagaccacaaaacatgccgtcagccgcggcaccgctaagcttcggtggttcgtggagagaaatctggtgaagcctgaagggaaagttattgacctcggatgtggccgcgggggatggtcctattactgcgccggcctgaagaaagtcacagaggtgaagggctataccaaagggggacccggccacgaagagcctatccccatggctacgtacgggtggaacctggccaagctccattctggaaaagatgtgtttttcatgcctccggaaaagtgtgacacccttctgtgcgatatcggcgagagctcccccaatcctacaattgaggaagggcggaccctgagagtcctcaagatggttgagccctggctgcgcggaaaccagttttgtatcaaaattcttaatccttacatgccctctgtggtggaaacactggagcaaatgcagcggaagcacggcggcatgctcgtcagaaacccgctgagccgcaattccacccacgagatgtattgggtgagctgcgggacaggaaacatcgtttctgcggtgaacatgacctcccggatgctgctcaatagattcacgatggcccatcgcaaacctacatacgaacgggacgtcgatctgggcgctgggaccagacacgtggccgttgagcccgaagtggctaaccttgacattatcggacagcgcattgagaatatcaagaacgaacataaaagcacctggcactatgatgaggacaatccctacaagacatgggcctatcacggctcttacgaggtcaagtccagcgggtctgcttccagcatggtgaacggagtggtcagactgctcacgaaaccttgggatgttatccccatggtgacccaaattgccatgacagacaccacaccttttggccagcagcgggtgttcaaggaaaaagtcgacacccgcacaccgagagcgaagcggggcaccacgcagatcatggaggtgaccgccaaatggctgtgggggtttctttccagaaataagaagccccggatttgtacacgcgaagagttcaccagaaaagttcggagcaacgctgccatcggagctgtgtttgtcgatgaaaatcaatggaactctgccaaggaggccgtggaggacgaacgcttctgggatctggttcatagagagcgggaactccacaaacagggcaagtgcgcgacatgcgtgtataatatgatggggaaacgcgagaagaagctgggagaatttggcaaagctaaggggagcagagccatttggtacatgtggctgggcgcccggttcctcgagttcgaggctctgggatttatgaacgaagaccattggttctcccgcgagaattctcttagcggcgtcgaaggggagggactgcacaaactcggctacatcctgagagatatctccaagattcctgggggaaacatgtatgccgacgataccgctggctgggacacgcggatcacagaggatgaccttcagaatgaagccaaaattaccgagatcatggaacccgagcatgcgctgctcgccacatctatttttaagctgacctaccagaacaaagtggttcgcgtgcaaagacctgctaagaacgggacggtcatggatgtgatcagccggcgcgaccagagaggctccggacaggtcggcacctatgggctgaatacattcaccaacatggaagtgcagctcatccggcaaatggagtctgagggaatttttctgcccagcgaacttgagacaccgaatctggccgaaagagttctcgattggctggagaagcacggcgctgaacgccttaaacggatggccatctccggggacgactgtgtggtcaagcctattgatgacagattcgcgaccgccctgacagctctcaacgatatgggaaaagtgcgcaaggacatcccccagtgggagcctagcaaaggctggaatgattggcagcaggtgcccttttgctctcaccatttccaccaactgattatgaaggacgggcgggagatcgttgtgccttgtagaaaccaggatgaactggtcggccgcgcccgggtgtcccagggagctggctggagcctcagagagaccgcctgcctggggaagtcttacgctcaaatgtggcagcttatgtattttcatcgccgggacctgagactcgccgcgaatgccatctgttccgctgttcccgtggattgggtcccgacgagccgcacaacctggtccattcacgcccaccatcagtggatgaccacagaagacatgctgtctgtgtggaaccgggtctggatcgaggaaaatccttggatggaggataaaacccacgtgagctcctgggaggaagttccctaccttggaaagagagaggaccagtggtgcggcagcctgattgggctcacagcccgggctacgtgggccaccaacatccaagtggcgattaatcaggtcagacgcctgatcggaaacgaaaattatctggactacatgacatctatgaaacggttcaagaacgagtccgatcccgagggcgctctctggtga

SEQ ID NO: 18633 - RNA, 9879 nt, synthetic construct
  misc_feature 1..9879: note = derived and/or modified CDS sequence (opt5) from DENV-1__GQ868534__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagtctgaacatacaggcagagagattgtcgacctcatgtgccacgccaccttcacaatgcgcctgctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctccggaaaaacggcaagcgcgttatccagctttctagaaagacgttcgacaccgagtatcagaaaacaaagaataacgactgggattacgtggtgaccacagacattagcgagatgggggccaatttccgggctgatagagtcatcgacccccgccggtgcctgaaaccggtgattctgaaggatggccctgaaagagttatcctcgccggacccatgcccgtgaccgtcgcctccgctgcccagcgccggggcagaattgggcgcaaccaaaataaagagggagaccagtacgtgtatatgggccagcctctgaacaatgatgaagaccacgcgcattggacagaggctaagatgcttctggataacatcaatacccccgaggggatcattcctgccctctttgaaccggagcgggaaaagaacgccgctatcgacggagagtacagactgcgcggcgaagccagaaaaacgttcgttgagctgatgcggcgcggggatctccccgtgtggctttcttataaggtcgcgagcgagggctttcagtactccgacagacggtggtgcttcgatggagaacgcaataaccaagtgctggaggaaaatatggacgtcgagatttggacaaaagaaggcgagagaaagaaactgcggcctagatggctcgacgcccgcacctatagcgatcccctggctcttcgggagtttaaggaattcgccgctgggagacgctctgtgtccggagacctgatcctcgagattggcaaactgcctcagcacctgaccctccgggcccagaacgctcttgataatctggttatgctgcacaacagcgaacaggggggaaaggcctacagacatgcgatggaggaactccccgacacaatcgagaccctgatgcttctggccctcatcgctgtgctgacaggcggcgtgacgctgtttttcctctccgggaagggacttggcaaaacctctattgggctgctgtgtgtcacagccagctccgctctcctgtggatggcctctgttgagccgcactggatcgccgctagcattatccttgaatttttcctgatggtgctcctgattcctgagcccgatcggcaacgcacccctcaggacaaccagctggcgtatgtggtcatcggactcctttttatgatcctgacagtggccgctaatgaaatgggcctgctcgagaccacgaagaaagatctggggattggacatgttgccgccgagaaccaccaacacgctaccatgcttgacgtggatctgagacccgcctccgcgtggacactctacgccgtcgctaccacagtgatcacccctatgatgcggcatacgattgaaaatacaaccgccaacatcagcctgacagctattgccaatcaggcggccatcctgatgggcctcgacaagggctggcccatttctaaaatggatatcggggtcccgcttctggctctgggatgctactcccaggtgaaccctctcaccctgaccgccgctgttcttatgctggtggcccactatgctatcattggccccgggctccaggccaaggcgacacgcgaggcccaaaagagaacggctgccggaatcatgaaaaatcccaccgtcgacggcattgtggctatcgatctggaccctgttgtgtacgacgccaagttcgaaaaacagctggggcagattatgctccttatcctgtgtacaagccagatcctgctcatgcggaccacatgggccctgtgcgagtctattacccttgcgacgggaccgctgacaaccctctgggaaggctcccccggcaagttttggaacaccacaatcgctgtcagcatggccaatattttccgcgggtcttatctggctggagccggcctggccttcagcctcatgaaatcccttgggggaggcagacgggggaccggagctcaaggcgagacactgggcgagaagtggaagcgccagctgaaccagctctctaaaagcgaatttaatacgtacaagagatccgggatcatggaggtggatcggagcgaagccaaagagggactgaagagaggcgaaaccacaaaacatgcggtgtcccgcgggaccgccaagcttcggtggttcgttgagagaaacctggtcaagcctgagggaaaagtgattgacctcggctgtgggcgcggaggctggtcttattactgcgctggcctgaagaaagtgacagaagtcaaggggtataccaaaggaggccccgggcacgaggaacctatccccatggccacgtacggatggaatctggttaagctccatagcggcaaagatgtgtttttcatccctccggagaagtgtgacacccttctgtgcgatattggggaatcctctcccaaccctacaatcgaggagggacggaccctgagagtgctcaagatggtcgaaccctggctgcgcggcaatcagttttgtattaaaatccttaacccttacatgcccagcgtggttgaggctctggaacaaatgcagcggaagcacggcgggatgctcgtgagaaatccgctgtcccgcaactctacacacgagatgtattgggtcagctgcggaaccggcaacattgtgtccgccgttaatatgacaagccggatgctgctcaacagattcaccatggcgcatcgcaaacctacgtacgagcgggacgtggatctgggggccggaacaagacacgtcgctgtggaacccgaggtggccaatcttgacatcattggccagcgcatcgaaaacatcaagaatgagcataaatctacctggcactatgatgaagacaacccctacaagacctgggcttatcacgggtcctacgaggtcaagcctagcggatctgcctccagcatggttaatggcgtggtgagactgctcacaaaaccctgggatgtcattcctatggtgacgcaaatcgctatgaccgacacaaccccgtttggccagcagcgggttttcaaggagaaagtggacacacgcacccccagagccaagcgggggacaacccagattatggaagtcacggcgaaatggctgtggggatttctttctagaaacaagaagcctcggatctgtacccgcgaggaattcacaagaaaagtgcggtccaatgccgctattggcgccgtttttgtggatgagaaccaatggaatagcgctaaggaagccgtcgaggacgagcgcttctgggatctggtgcatagagaacgggagctccacaaacaggggaagtgcgccacctgcgtttataacatgatgggaaaacgcgaaaagaagctgggcgagtttgggaaagcgaagggctccagagctatctggtacatgtggctgggagcccggttcctcgaattcgaggccctgggctttatgaatgaggaccattggttcagccgcgaaaactctcttagcggggtggagggagaaggcctgcacaaactcgggtacatcctgagagatatttccaagatccccggaggcaatatgtatgctgacgatacagccgggtgggacacccggattacggaggatgaccttcagaacgaggctaaaatcacagaaattatggagcctgaacatgccctgctcgcgacctctatctttaagctgacataccagaacaaagtcgtgcgcgtccaaagacccgccaagaatggcaccgtgatggatgttatcagccggcgcgaccagagaggatccggccaggtggggacgtatggactgaacaccttcacaaatatggaggtccagctcattcggcaaatggaatctgagggcatctttctgccgagcgagcttgaaacccctaacctggctgagagagccctcgattggctggaaaagcacggggctgagcgccttaaacggatggccatttccggagacgactgtgtggtgaagcccatcgatgacagattcgcgacagccctgaccgctctcaatgatatgggcaaagttcgcaaggacattcctcagtgggaaccctctaaagggtggaacgattggcagcaggtgcctttttgcagccaccatttccaccaactgatcatgaaggacggccgggagatcgtcgtgccctgtagaaatcaggatgagctggttggacgcgcccgggtgtcccagggcgctgggtggagcctcagagaaacagcctgcctgggaaagtcttacgctcaaatgtggcagcttatgtattttcatcgccgggacctgagactcgccgcgaacgccatttgttccgctgtcccggtggattgggtccctaccagccgcacgacatggtctatccacgcccaccatcagtggatgaccaccgaggacatgctgtccgtgtggaatcgggtttggattgaagagaacccctggatggaagataaaacacacgtgagctcctgggaggaggtcccctaccttggcaagagagaagaccagtggtgcgggtctctgatcggactcaccgcccgggctacatgggccacgaatattcaagtggcgatcaaccaggttagacgcctgattggcaatgagaactatctggactacatgaccagcatgaaacggttcaagaatgaatccgatcctgagggggctctctggtga

SEQ ID NO: 18634 - RNA, 9879 nt, synthetic construct
  misc_feature 1..9879: note = derived and/or modified CDS sequence (opt5) from DENV-1__GQ868535__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcgccaaccctgcgattcttcggaaactgtgcatcgaagccaagatttctaatacaaccacggactcccgctgtccgacacagggagaggctaccctcgttgaagagcaggatgccaacttcgtgtgcagacggacctttgtggaccgcggctggggcaatgggtgtggactgttcggcaaagggagccttctgacatgcgctaagtttaagtgcgtcaccaaactcgagggaaagatcgtgcagtacgaaaacctgaaatattctgttatcgtgacagtccacacgggcgatcaacatcaggtggggaatgagaccacagaacacggaaccattgccacaatcaccccccaggcccctacgtccgagattcagctgaccgactacggcgctctcacactggactgtagccccagaaccggccttgatttcaacgaaatggttctgctcacaatgaaggagaaatcttggctggtgcataagcaatggtttcttgacctgcctctcccctggacctccggggcgagcacgtcccaggagacatggaatcggcaggatctgctggtcaccttcaaaacagcccacgctaagaagcaagaagtggtcgtgctcggatctcaggagggcgccatgcacaccgccctgaccggggctacagaaatccagacgagcggaaccacaaccatttttgccggccatcttaaatgccgcctgaagatggacaaactcacactgaaggggacctcctatgttatgtgtacgggcagcttcaaactggagaaggaagtggcggagacacagcacggaaccgtccttgtgcaagttaagtacgagggcaccgatgctccgtgcaaaatccctttctctacacaggacgaaaagggggtgacccagaacggaagactcatcacagccaatcccattgtcacggataaagagaagcctgtgaacatcgaaaccgagcccccctttggcgagtcctatattgtggttggggccggagaaaaagctctgaagctgagctggttcaagaaaggctctagcatcgggaagatgtttgaggccacagctcggggcgccagacgcatggcgattctcggagacaccgcctgggatttcggctccatcgggggagtctttacatctgtgggcaaactggtgcatcaggtcttcgggaccgcttacggagtgctttttagcggcgtttcctggacgatgaagatcgggattggcatcctgctcacctggctgggactgaatagccggtctacatcccttagcatgacctgtattgccgtgggcatggtcacactctacctgggggtgatggttcaagctgactctggatgcgtgatcaactggaaaggcagagaactgaagtgtgggtccggaattttcgtcaccaacgaggtgcacacatggaccgaacagtataagtttcaggccgatagccctaaacgcctctccgcggccatcggcaaggcttgggaggagggggtttgcggcattcggtctgccacgagactggaaaatatcatgtggaaacagatcagcaacgagcttaatcatattctgctcgaaaacgacatgaagttcacagtggtcgtgggagacgctaatggcatcctggcccaagggaaaaagatgattcgcccgcagcccatggagcacaaatactcctggaagtcttggggaaaggccaaaatcattggcgctgatatccagaacaccacctttatcattgacgggcctgatacacccgaatgtcctgacaatcagcgggcgtggaacatctgggaggtggaggattatggattcggcatttttaccacgaatatctggctgaagcttagagacagctacacacaaatgtgcgatcaccgcctcatgtccgccgctattaaagacagcaaggccgtccatgccgatatgggctattggatcgaatctgagaaaaacgaaacctggaagctggctcgggcctccttcatcgaggttaagacatgtacctggcccaaaagccacacactgtggtctaatggggtgctcgaatccgagatgattatcccgaagatttacggaggccctatcagccagcataactatagacccgggtacttcacccagacggcgggaccttggcacctgggcaaacttgagctggactttgatctctgcgaagggaccacagtggtcgtggacgagcactgcggaaatcgcggcccctctctgcggaccacaaccgttacgggcaagattatccatgaatggtgttgcagaagctgtacactgcctccccttcggttccgcggggaggatggatgctggtacggcatggagatcagaccggtgaaagaaaaggaggaaaacctcgtccggtccatggtgagcgctgggtctggagaggttgactcctttagcctgggcattctgtgtgcctccatcatgattgaagaggtgatgagatctcgctggagccggaagatgctcatgaccgggacactggccgtcttccttctgctcatcatgggacaactgacctggaatgacctgattagactttgcatcatggtgggcgctaacgcctccgatcgcatgggcatggggaccacatatctggcgctcatggctacgtttaaaatgagacctatgttcgccgttggactgctctttcggcgcctgacctctagagaggtgcttctgctcacaattggcctgagcctggtcgcctccgtggaacttcccaactctctggaggaactcggggacggactggctatgggcatcatgatgctcaagctgcttaccgagttccagccccaccagctgtggacaaccctcctgagcctgacgtttatcaaaacaaccctttccctggattacgcctggaagaccacagctatggccctcagcattgtgtctctgttccctctctgtctgtccaccacaagccagaaaacgacctggcttccggtcctgctggggtcttttggatgcaagcccctcacaatgttcctgatcaccgaaaataagatttggggccggaaatcctggcctcttaacgagggcatcatggcgattgggatcgttagcatcctgctctcttccctgctcaagaatgacgtgcccctggccggacctcttattgctggcgggatgctgatcgcctgttatgtgattagcggatccagcgctgatctgtctctcgagaaagccgccgaagtcagctgggagcaagaagctgagcattccggcacatctcacaacatcctggtggaagttcaggacgatgggaccatgaagattaaagacgaggagcgcgatgacacgcttaccatcctgctcaaggcgacactgctcgccgtgagcggagtctaccccatgtccatccctgctaccctgtttgtgtggtatttctggcagaaaaagaagcagagatctggcgttctttgggatacacccagcccgcctgaagtggagcgggccgtcctggacgatggcatttaccgcatcctgcaaagagggctcctgggacggtcccaggtgggcgtcggggtgttccaggacggagtttttcataccatgtggcacgtgacacgcggcgccgtccttatgtatcaggggaaaagactggaaccctcttgggctagcgtgaagaaagacctcatttcctacggaggcggctggcggttccaagggagctggaatatgggagaggaggttcaggtgatcgccgtcgaacctggcaagaaccccaaaaatgtgcagacgaccccggggacatttaagacccctgagggagaagtgggcgcgattgctctggatttcaagcccgggacctctggatcccctatcgttaacagagagggcaaaattgtcggcctctacgggaatggagtggtgacaacgagcggcacctatgtctctgccatcgcccaagctaaggcctcccaggaagggcccctgcccgagatcgaggacgaagtgtttaaaaagcgcaaccttacaattatggatctgcaccctggaagcggcaaaacccggagatacctgccggcgatcgttcgcgaggctattaagcggaagctcagaacactgatccttgcccccacccgcgtggtcgcctccgaaatggctgaggccctgaaagggatgcctattcggtatcagacgacagctgtgaagtctgaacataccggcagagagatcgttgacctcatgtgccacgccaccttcacaatgcgcctgctgagccccgtgcgggtccctaattacaacatgatcattatggatgaggcgcattttaccgaccccgcctccatcgctgccagaggatatattagcacacgggtgggcatgggggaagctgccgccatcttcatgaccgctacgcctccgggatctgttgaggcgtttccccagtccaatgccgtgattcaagatgaagagcgcgacatccctgaaagaagctggaactctggctacgattggatcacagacttccccgggaaaaccgtctggtttgtgcctagcattaagtccggaaatgatatcgctaactgtctccggaaaaacggcaagcgcgtgattcagctttctagaaagacattcgacaccgagtatcagaaaacgaagaataacgactgggattacgtcgttaccacagacatcagcgagatgggggccaatttccgggccgatagagtgattgacccccgccggtgcctgaaaccggtgatcctgaaggatggccctgaaagagtcattctcgctggacccatgcccgtgaccgttgcctccgcggctcagcgccggggcagaatcgggcgcaaccaaaataaagagggagaccagtacgtgtatatgggccagcctctgaacaatgatgaagaccacgcccattggacagaggccaagatgcttctggataacatcaatacccccgaggggattatccctgctctctttgaaccggagcgggaaaagtctgccgcgattgacggagagtacagactgcgcggcgaagccagaaaaacattcgtcgagctgatgcggcgcggggatctccccgtgtggcttagctataaggttgcttccgagggctttcagtacagcgacagacggtggtgcttcgatggagaacgcaacaatcaagtgctggaggaaaacatggacgtcgagatctggaccaaagaaggcgagagaaagaaactgcggcctagatggctcgacgcccgcacgtattctgatcccctggctcttcgggagtttaaggaattcgccgctgggagacgctccgtgagcggagacctgattctcgagatcggcaaactgcctcagcacctgacactccgggcccagaatgcgcttgataacctggtcatgctgcacaattccgaacaggggggaaaggcctacagacatgctatggaggaactccccgacaccatcgagaccctgatgcttctggccctcattgctgtgctgacaggcggcgttaccctgtttttcctctctgggaagggacttggcaaaacaagcatcgggctgctgtgtgtgacggcctcctctgccctcctgtggatggctagcgtggagccgcactggattgcggcctccatcattcttgaatttttcctgatggtcctcctgatccctgagcccgatcggcaacgcacccctcaggacaaccagctggcttatgttgtgatcggactcctttttatgattctgacagtggccgccaacgaaatgggcctgctcgagaccacaaagaaagatctggggatcggacatgtcgctgccgagaatcaccaacacgcgaccatgcttgacgtggatctgagacccgccagcgcttggacgctctacgccgttgctaccacagtgattacccctatgatgcggcatacaatcgaaaacaccacggccaatatttctctgacagcgatcgccaaccaggctgccattctgatgggcctcgacaagggctggcccatctccaaaatggatatcggggtcccgcttctggctctgggatgctacagccaggtgaatcctctcaccctgacagccgctgtccttatgctggtggcccactatgcgattatcggccccgggctccaggccaaggctacccgcgaggcccaaaagagaaccgctgccggaattatgaaaaaccccacagttgacggcatcgtggccattgatctggaccctgtcgtgtacgacgcgaagttcgaaaaacagctggggcagatcatgctccttatcctgtgtacgtctcagattctgctcatgcggaccacatgggctctgtgcgagtccatcacccttgccacaggaccgctgaccacgctctgggaaggcagccccggcaagttttggaatacaaccattgctgtttctatggccaacatcttccgcgggagctatctggccggagctggcctggccttctccctcatgaaatctcttgggggaggcagacgggggaccggagcgcaaggcgagacactgggcgagaagtggaagcgccagctgaatcagctcagcaaatccgaatttaacacctacaagagaagcgggattatggaggtggatcggtccgaagccaaagagggactgaagagaggcgaaacaacgaaacatgctgtctctcgcgggaccgccaagcttcggtggttcgtggagagaaatctggtgaagcctgagggaaaagttatcgacctcggctgtgggcgcggaggctggagctattactgcgctggcctgaagaaagtcacagaagtgaaggggtataccaaaggaggccccgggcacgaggaacctatccccatggccacatacggatggaacctggtgaagctccattccggcaaagatgtctttttcatgcctccggagaagtgtgacacccttctgtgcgatattggggaatctagccccaatcctacgatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgcggtcaacatgacctctcggatgctgctcaatagattcacaatggcccatcgcaaacctacctttgagcgggacgtggatctgggggctggaacgagacacgttgccgtggaacccgaggtcgctaaccttgacatcattggccagcgcatcgaaaatatcaagaacgagcataaatccacatggcactacgatgaagacaatccctataagacctgggcctaccacgggagctatgaggtgaagccttctggatccgctagctctatggtgaacggcgtcgttagactgctcaccaaaccctgggatgtgattcctatggtgacacaaatcgccatgacggacaccacaccgttcggccagcagcgggtctttaaggagaaagtggacacccgcacacccagagcgaagcgggggaccacacagattatggaagttaccgccaaatggctgtggggattcctttccagaaataagaagcctcggatctgtacgcgcgaggaatttaccagaaaagtgcggagcaacgctgccattggcgctgtcttcgtggatgagaatcaatggaactccgccaaggaagccgttgaggacgagcgcttttgggatctggtgcatagagaacgggagctccacaaacaggggaagtgcgcgacatgcgtctacaatatgatgggaaaacgcgaaaagaagctgggcgagttcgggaaagctaagggcagcagagccatctggtatatgtggctgggagcccggttcctcgaatttgaggctctgggcttcatgaacgaggaccattggttttctcgcgaaaatagcctttccggggtggagggagaaggcctgcacaaactcgggtacatcctgagagatatttctaagatccccggaggcaacatgtacgccgacgataccgctgggtgggacacacggattaccgaggatgaccttcagaatgaggccaaaatcacggatattatggaacctgagcatgcgctgctcgccacaagcatcttcaagctgacctatcagaacaaagttgtgcgcgtccaaagacccgctaagaacggcacagtgatggacgtcatctcccggcgcgatcagagaggatctggccaggtggggacctacggactgaatacgtttaccaacatggaagttcagctcattcggcaaatggagagcgaaggcatcttcctgccgtccgagcttgagacacctaatctggccgaaagagtgctcgactggctggagaagcacggggctgaacgccttaaacggatggccatttctggagacgattgtgtcgtgaagcccatcgacgatagatttgcgaccgccctgacagctctcaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctggtgggacgcgcccgggttagccagggcgctgggtggtctctcagagagaccgcctgcctgggaaagtcctatgctcaaatgtggcagcttatgtacttccatcgccgggatctgagactcgccgcgaatgccatttgtagcgctgtgccggtcgactgggtgcctacatctcgcaccacgtggtccatccacgcccaccatcagtggatgacaaccgaagatatgctgagcgtctggaaccgggtgtggattgaggaaaatccctggatggaggacaaaacccacgtttcctcttgggaagaggtgccctatcttggcaagagagaggaccagtggtgcgggagcctgatcggactcacagcccgggctacctgggccacaaacattcaagtcgcgatcaatcaggtgagacgcctgattggcaacgaaaattacctggattatatgacgtccatgaaacggtttaagaacgagagcgaccctgaaggggctctctggtga

SEQ ID NO: 18635 - RNA, 9879 nt, synthetic construct
  misc_feature 1..9879: note = derived and/or modified CDS sequence (opt5) from DENV-1__KJ189306__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaaatctctgctttttaagacaagcgccggcgttaatatgtgcaccctgattgcgatggacctcggggaactgtgtgaagatacaatgacctacaaatgcccgcagatcacagaagctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcccgttcaaactggagaaggaagtggccgagacccagcacggaaccgtccttgtgcaagttaagtacgagggcacagatgcgccttgcaaaatccccttcctcacccaggacgaaaagggggtgacacagaacggaagactgatcacggctaatcctattgtcaccgataaagagaagcccgtgaacatcgaaacagagcccccttttggcgagagctatattgtggttggggccggagaaaaagccctgaagctctcttggttcaagaaaggctccagcatcgggaagatgtttgaggctaccgcccggggcgctagacgcatggccattctgggagacacagcgtgggatttcggctctatcgggggagtctttaccagcgtgggcaaacttgtgcatcaggtcttcgggacggcctacggagtgctgttttccggcgtttcttggaccatgaagatcgggattggcatcctcctgacatggctgggacttaatagccggtccaccagcctctctatgacatgtattgctgtgggcatggtcaccctgtacctgggggtgatggttcaagccgactccggatgcgtgatcaactggaaaggcagagaactcaagtgtgggagcggaattttcgtcacaaacgaggtgcacacctggacggaacagtataagtttcaggctgattctccgaaacgcctgtccgccgcgatcggcaaggcctgggaggagggggtttgcggcattcggagcgctacaagacttgaaaatatcatgtggaaacagatctccaacgagctgaatcatattctcctggaaaacgacatgaagttcaccgtggtcgtgggagacgccaatggcatcctggctcaagggaaaaagatgattcgcccccagcctatggagcacaaatactcttggaaaagctggggaaaggccaagatcattggcgccgatatccagaacaccacatttatcattgacgggcccgatacccctgaatgtcccgacaatcagcgggcttggaacatctgggaggtggaggattatggattcggcatttttacgacaaatatctggcttaagctcagagactcctacacccaaatgtgcgatcaccgcctgatgtctgcggccattaaagacagcaaggctgtccatgccgatatgggctattggatcgaatccgagaaaaacgaaacatggaagctggcccgggctagcttcatcgaggttaagacctgtacatggccgaaatctcacaccctctggtccaatggggtgctggaaagcgagatgattatccctaagatttacggaggccccatctctcagcataactatagacctgggtacttcacgcagaccgccggaccctggcaccttggcaaactggagctcgactttgatctgtgcgaagggacaaccgtggtcgtggacgagcactgcggaaatcgcggcccttccctgcggacaaccacggttacaggcaagattatccatgaatggtgttgcagaagctgtacccttcccccgctccggttccgcggggaggatggatgctggtacggcatggagatcagacctgtgaaagaaaaggaggaaaacctggtccggtctatggtgagcgcggggtccggagaggttgacagcttttctctgggcattctctgtgtgtccatcatgattgaagaggtcatgagaagccgctggtcccggaagatgctgatgacagggacccttgctgtgttcctgctcctggttatgggacaactgacctggaatgaccttatcagactgtgcattatggtgggcgccaacgcctctgatcgcatgggcatggggacaacgtatctcgctctgatggccacctttaaaatgagacccatgttcgcggtcggactcctgtttcggcgccttacaagcagagaggtgctgctcctgaccatcggcctgtcccttgtggcttctgtcgaactgcccaacagcctcgaggaactgggggacggactcgccatgggcattatgatgctgaaacttctgacagagttccagcctcaccagctctggaccacgctgctgtcccttacatttatcaaaaccaccctgtctctcgattacgcctggaagacaaccgctatggccctgagcatcgtttccctcttcccgctgtgtcttagcacaacgtctcagaaaaccacatggctgcccgtgctgctcgggtcctttggatgcaagcctctgaccatgttccttattacagaaaataagatctggggccggaaaagctggcccctgaacgagggcattatggctatcgggattgtgtctatcctcctgtccagcctcctgaagaatgacgtccctcttgccggacccctgatcgcgggcgggatgctgattgcctgttatgtgatctctggatccagcgctgatctctccctggagcgcgccgctgaagttagctgggagcaagaagccgagcattctggcaccagccacaacattcttgtggaagtccaggacgatgggacgatgaaaatcaaggacgaggagagagatgacaccctgacaattctcctgaaagccaccctcctggctgtgtccggagtttaccctatgtctatccccgcgacactttttgtgtggtatttctggcagaagaaaaagcagcggagcggcgtcctgtgggataccccgtcccctcccgaagtggagcgcgccgtcctggacgatggcatctaccggattctgcaaagagggctgcttggacgctctcaggtgggcgttggggtgttccaggacggagtctttcatacaatgtggcacgtgacgagaggcgctgttctgatgtatcaggggaagcggctcgaacctagctgggcctccgtgaaaaaggacctgatctcttacggaggcggctggagattccaagggagctggaataccggagaggaggtccaggtgattgccgtggaacccggcaaaaacccgaagaatgttcagacaacccctgggacctttaaaacacccgagggagaagtcggcgctatcgccctcgatttcaagcctgggacgtccggaagccccattgtgaaccgcgagggcaagatcgtgggcctgtacgggaatggagtcgtgaccacatctggcacctatgtttccgcgattgctcaagccaaagccagccaggaagggccccttcctgagatcgaggacgaagtgtttaagaaacggaacctgacaatcatggatctgcacccgggatctggcaagaccagacgctacctccccgctattgtccgggaggccatcaaaagaaagctgcgcacgcttattctggcgcctacacgggtggttgcttccgaaatggccgaggccctcaaggggatgcccatcagatatcagaccaccgctgtgaaaagcgaacatacaggccgcgagattgtcgacctgatgtgccacgccaccttcacaatgcggctgctctcccctgtgagagttcccaattacaacatgatcatcatggatgaggctcattttaccgaccctgcctctattgcggcccggggatatatcagcacgcgcgtgggcatgggggaagctgccgctattttcatgacagccaccccgcccggatccgtcgaggcctttcctcagagcaatgctgtgatccaagatgaagagagagacattcccgaacggtcttggaactccggctacgattggatcacagacttccctgggaagaccgtgtggtttgtccccagcatcaaatctggaaatgatattgcgaactgtcttcgcaagaacggcaaaagagttatccagctgagccggaagacgttcgacaccgagtatcagaagaccaagaataacgactgggattacgtggtgaccacagacatttccgagatgggggccaatttcagagctgatcgcgtcatcgacccgcggagatgcctgaagcctgtgattctcaaagatggccccgaacgcgttatcctggccggacccatgcctgtgaccgtcgcctctgctgcccagcggagaggccgcattgggcggaaccaaaataaggagggagaccagtacgtgtatatgggccagccccttaacaatgatgaagaccacgcgcattggacagaggctaaaatgctgctcgataacatcaatacccctgaggggatcattccggccctgtttgaacccgagagagaaaagagcgccgctatcgacggagagtaccgcctgagaggcgaagcccggaagacgttcgttgagctcatgcgcagaggggatcttcctgtgtggctgtcctataaagtcgcgtctgagggctttcagtacagcgaccggcgctggtgcttcgatggagaaagaaacaatcaagtgctggaggaaaacatggacgtcgagatttggacaaaggaaggcgagcggaaaaagctcagaccccgctggctggacgcccggacctattccgatcctcttgctctgagagagtttaaagagttcgccgctgggcgccggagcgtgtctggagacctcatcctggagattggcaagctgccccagcacctcacccttagagcccagaatgctctggataacctggttatgctccacaattccgaacaagggggaaaagcctaccggcatgcgatggaggaactgccggacacaatcgagacccttatgctgctcgccctgatcgctgtgctgacaggcggcgtgacgctctttttccttagcgggaagggactgggcaagacctccattgggctgctctgtgtcacagcctctagcgctctgctttggatggcctccgttgagcctcactggatcgccgcttctattatcctggaatttttcctcatggtgctgctgattcccgagcctgatcgccaaagaacaccccaggacaaccagctcgcgtatgtggtcatcggacttctgtttatgatcctgacagtggccgctaacgaaatgggcctcctggagaccacgaaaaaggatcttgggattggacatgttgccgccgagaatcaccaacacgctaccatgctggacgtggatctccggcctgccagcgcgtggacactgtacgccgtcgctaccacagtgatcacccccatgatgcgccatacgattgaaaacacaaccgccaatatctccctgacagctattgccaaccaggcggccatcctcatgggccttgacaaaggctggccgattagcaagatggatatcggggtccctctgctggctctcggatgctactctcaggtgaatcccctgacccttaccgccgctgttctgatgctcgtggcccactatgctatcattggccccgggctgcaggccaaagcgacaagagaggcccaaaagcggacggctgccggaatcatgaagaaccctaccgtcgacggcattgtggctatcgatctggacccggttgtgtacgacgccaaattcgaaaagcagctcgggcagattatgcttctgatcctgtgtacatcccagatcctcctgatgcgcaccacatgggccctttgcgagagcattaccctggcgacgggacccctcacaaccctgtgggaaggctctcctggcaaattttggaataccacaatcgctgtctccatggccaacattttcagagggagctatctggctggagccggcctcgccttctctcttatgaaaagcctcgggggaggccggcgcgggaccggagctcaaggcgagacactgggcgagaaatggaagagacagctcaatcagctgtccaagtctgaatttcatatctacaaacggagcgggattatggaggtggatagatccgaagccaaggagggacttaaacgcggcgaaacgaccaagcacgcggtgagccgggggacagccaaactgagatggttcgttgagcgcaacctcgtcaagcccgagggaaaggtgatcgacctgggctgtgggcggggaggctggtcctattactgcgctggcctgaaaaaggtgaccgaagtcaaagggtatacaaagggaggccctgggcatgaggaacccatccctatggccacctacggatggaatctcgttaaacttcactctggcaaggatgtgtttttcatgccgcccgagaaatgtgacacgctgctgtgcgatattggggaaagctcccctaaccccaccatcgaggagggaagaacactccgcgtgctgaagatggtcgaaccttggcttcggggcaatcagttttgtattaagatcctgaacccctacatgccgtctgtggttgagaccctcgaacaaatgcagagaaaacacggcgggatgctggtgcgcaatcctctgagccggaactccacacatgagatgtattgggtctcttgcggaaccggcaatattgtgagcgctgttaacatgacatccagaatgctcctgaaccgcttcaccatggcccaccggaagcccacgtacgagagagacgtggatcttggggcgggaacacgccatgtcgccgtggaacccgaggtggctaatctggacatcattggccagagaatcgaaaacatcaaaaatgagcacaagagcacctggcactatgatgaagacaacccttacaaaacctgggcctatcatgggtcttacgaggtcaagccctccggaagcgcttcttccatggttaatggcgtggtgcggctcctgacaaagccttgggatgtcattccgatggtgacgcaaatcgccatgaccgacacaaccccctttggccagcagcgcgttttcaaagagaaggtggacacaagaacccctcgggctaaaagagggacaacccagattatggaagtcacggccaagtggctttggggatttctgagccggaacaaaaagccccgcatctgtaccagagaggagttcattcggaaggtgcgctctaatgcggccatcggcgctgtttttgtggatgagaaccaatggaactccgccaaagaagctgtcgaggacgagagattctgggatctcgtgcaccgggaacgcgagctgcataagcaggggaaatgcgccacatgcgtttataacatgatgggaaagagagagaagaagctgggcgagtttgggaaggccaaaggcagccgggcgatctggtacatgtggctcggagctcgcttcctggagttcgaggcccttggctttatgaatgaggaccactggttctccagagaaaacagcctgtctggggtggagggagaaggcctccataagctggggtacattcttcgggatatcagcaaaattcctggaggcaatatgtatgccgacgataccgctgggtgggacacacgcatcaccgaggatgacctgcagaacgaggccaagattacggaaatcatggagcccgaacacgctctcctggccacatccatctttaaactgacctaccagaataaggtcgtgagagtccaacggccggcgaaaaacggcacagtgatggatgttatttctcgcagagaccagcggggaagcggccaggtggggacctatggactcaacacgttcaccaatatggaggtccagctgatcagacaaatggaatccgagggcatttttcttccttctgagctggaaacacccaacctcgccgagcgcgtgctggattggcttgaaaagcacggggctgagcggctgaagagaatggccatcagcggagacgactgtgtggttaaacctattgatgaccgcttcgctaccgccctcacagcgctgaatgatatgggcaaggtgcggaaagacatcccccagtgggaaccttccaaggggtggaacgattggcagcaggtccccttttgctctcatcacttccatcaactgatcatgaaagacggcagagagattgtggttccgtgtcgcaatcaggatgagctcgtgggacgggccagagtcagccagggcgctgggtggtccctgcgcgaaaccgcctgccttggaaagagctacgctcaaatgtggcagctgatgtattttcaccggagagacctccgcctggccgctaacgccatctgttctgcggtgcctgtcgattgggtgcccacatcccggaccacgtggagcattcacgcccatcaccagtggatgacaaccgaggacatgctttctgtttggaatagagtgtggatcgaagagaacccctggatggaagataagacccatgtctccagctgggaggaggtgccttacctgggcaaacgggaagaccagtggtgcgggtccctcattggactgacagctagagccacctgggccacaaatatccaagttgctattaaccaggtgcgccggctgatcggcaatgagaactatctcgactacatgacgtctatgaagagattcaaaaatgaaagcgatccggagggggccctgtggtga

SEQ ID NO: 18636 - RNA, 9879 nt, synthetic construct
  misc_feature 1..9879: note = derived and/or modified CDS sequence (opt5) from DENV-1__KJ189307__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgcctttttcctggcgcatgccattgggacatctatcacccaaaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaagaataaacccacactggatatcgaactgctcaagaccgaggtcacaaaccctgccattctgcggaaactttgcatcgaagcgaagatttctaataccacgacagactcccgctgtccgacccagggagaggccaccctggttgaagagcaggatgctaactttgtgtgcagacggacattcgtggaccgcggctggggcaatgggtgtggactctttggcaaagggagcctgcttacctgcgccaagttcaagtgcgtcacaaaactggagggaaagatcgtgcagtacgaaaacctcaaatattctgttatcgtgacggtccacaccggcgatcaacatcaggtggggaatgagacaaccgaacacggaacaattgctaccatcacgccccaggcccctacctccgagattcagctgacagactacggcgccctgaccctcgactgtagccccagaacaggcctggattttaacgaaatggttcttctgaccatgaaggagaaatcttggctcgtgcataagcaatggttcctggaccttcctctgccctggacgtccggggctagcacatcccaggagacctggaatcggcaggatctcctggtcacatttaaaaccgcgcacgccaagaagcaagaagtggtcgtgctgggatctcaggagggcgctatgcacaccgccctcacaggggccacggaaatccagaccagcggaacaaccacaattttcgctggccatctgaaatgccgccttaagatggacaaactgaccctcaaggggacgtcctatgttatgtgtacaggcagcttcaaactggagaaggaagtggccgagacccagcacggaaccgtcctggtgcaagttaagtacgagggcacagatgcgccgtgcaaaatccctttttctacccaggacgaaaagggggtgacacagaacggaagacttatcacggctaatcccattgtcaccgataaagagaagcctgtgaacatcgaaacagagccccccttcggcgagtcctatattgtggttggggccggagaaaaagccctcaagctgagctggtttaagaaaggctctagcatcgggaagatgttcgaggctaccgcccggggcgctagacgcatggccattctgggagacacagcgtgggattttggctccatcgggggagtcttcacctctgtgggcaaactcgtgcatcaggtctttgggacggcctacggagtgctgttcagcggcgtttcctggaccatgaagatcgggattggcatccttctgacatggctcggactgaatagccggtctacctccctgagcatgacatgtattgctgtgggcatggtcaccctttacctcggggtgatggttcaagccgactctggatgcgtgatcaactggaaaggcagagaactgaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagactcgaaaatatcatgtggaaacagatcagcaacgagctgaatcatattcttctggaaaacgacatgaagtttaccgtggtcgtgggagacgccaatggcatcctcgctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacaatcagcgggcttggaacatctgggaggtggaggattatggatttggcattttcacgacaaatatctggctgaagctgagagacagctacacccaaatgtgcgatcaccgccttatgtccgcggccattaaagacagcaaggctgtccatgccgatatgggctattggatcgaatctgagaaaaacgaaacatggaagctcgcccgggcttccttcatcgaggttaagacctgtacatggcccaaaagccacaccctgtggtctaatggggtgctggaatccgagatgattatcccgaagatttacggaggccctatcagccagcataactatagacccgggtactttacgcagaccgccggaccttggcacctcggcaaactggagcttgacttcgatctgtgcgaagggacaaccgtggtcgtggacgagcactgcggaaatcgcggcccctctctccggacaaccacggttacaggcaagattatccatgaatggtgttgcagaagctgtaccctgcctcccctgcggtttcgcggggaggatggatgctggtacggcatggagatcagaccggtgaaagaaaaggaggaaaaccttgtccggtccatggtgagcgcggggtctggagaggttgactccttcagcctcggcattctgtgtgtgtccatcatgattgaagaggtcatgagatctcgctggagccggaagatgctgatgacagggaccctcgctgtgtttctgcttctggttatgggacaactcacctggaatgacctgatcagactgtgcattatggtgggcgccaacgcctccgatcgcatgggcatggggacaacgtatcttgctctgatggccaccttcaaaatgagacctatgtttgcggtcggactcctgttccggcgcctcacatctagagaggtgctgcttctgaccatcggcctcagcctggtggcttccgtcgaactgcccaactctcttgaggaactgggggacggactcgccatgggcattatgatgctgaagctcctgacagagtttcagccccaccagctttggaccacgctgctcagcctgacattcatcaaaaccaccctgtcccttgattacgcctggaagacaaccgctatggccctgagcatcgtttctctctttcctctgtgtctctccacaacgagccagaaaaccacatggctgccggtgcttctggggtctttcggatgcaagcccctgaccatgtttctcattacagaaaataagatctggggccggaaatcctggcctctgaacgagggcattatggctatcgggattgtgagcatccttctgtcttccctcctgaagaatgacgtccccctcgccggacctctgatcgcgggcgggatgcttattgcctgttatgtgatcagcggatccagcgctgatctgtctctggagaaagccgctgaagttagctgggagcaagaagccgagcattccggcacctctcacaacattcccgtggaagtccaggacgatgggacgatgaagatcaaagacgaggagcgcgatgacaccctcacaattctgcttaaggccaccctgctcgctgtgagcggagtttaccctatgtccatccccgcgacactgttcgtgtggtatttctggcagaaaaagaagcagagatctggcgtcctctgggataccccgagccctcccgaagtggagcgggccgtcctggacgatggcatctaccgcattcttcaaagagggctgctgggacggtcccaggtgggcgttggggtgtttcaggacggagtcttccatacaatgtggcacgtgacgcgcggcgctgttctcatgtatcaggggaaaagactggaaccttcttgggccagcgtgaagaaagaccttatctcctacggaggcggctggcggtttcaagggagctggaataccggagaggaggtccaggtgattgccgtggaacccggcaagaacccgaaaaatgttcagacaacccctgggaccttcaagacacccgagggagaagtcggcgctatcgccctggattttaagcctgggacgtctggatcccccattgtgaacagagagggcaaaatcgtgggcctctacgggaatggagtcgtgaccacaagcggcacctatgtttctgcgattgctcaagccaaggcctcccaggaagggcccctgcctgagatcgaggacgaagtgttcaaaaagcgcaacctcacaatcatggatctgcacccgggaagcggcaaaacccggagataccttcccgctattgtccgcgaggccatcaagcggaagctgagaacgctgattctcgcgcctacacgcgtggttgcttccgaaatggccgaggccctgaaagggatgcccatccggtatcagaccaccgctgtgaagtctgaacatacaggcagagagattgtcgaccttatgtgccacgccacctttacaatgcgcctgctcagccctgtgcgggttcccaattacaacatgatcatcatggatgaggctcatttcaccgaccctgcctccattgcggccagaggatatatcagcacgcgggtgggcatgggggaagctgccgctatttttatgacagccaccccgcccggatctgtcgaggccttccctcagtccaatgctgtgatccaagatgaagagcgcgacattcccgaaagaagctggaactctggctacgattggatcacagactttcctgggaaaaccgtgtggttcgtccccagcatcaagtccggaaatgatattgcgaactgtctgcggaaaaacggcaagcgcgttatccagctgtctagaaagacgttcgacaccgagtatcagaaaacaaagaataacgactgggattacgtggtgaccacagacattagcgagatgggggccaattttcgggctgatagagtcatcgacccgcgccggtgcctcaaacctgtgattcttaaggatggccccgaaagagttatcctggccggacccatgcctgtgaccgtcgcctccgctgcccagcgccggggcagaattgggcgcaaccaaaataaagagggagaccagtacgtgtatatgggccagcccctgaacaatgatgaagaccacgcgcattggacagaggctaagatgctcctggataacatcaatacccctgaggggatcattccggcccttttcgaacccgagcgggaaaagaacgccgctatcgacggagagtacagactgcgcggcgaagccagaaaaacgtttgttgagctcatgcggcgcggggatctgcctgtgtggctgtcttataaggtcgcgagcgagggcttccagtactccgacagacggtggtgctttgatggagaacgcaataaccaagtgctcgaggaaaatatggacgtcgagatttggacaaaagaaggcgagagaaagaaacttcggcccagatggctggacgcccgcacctatagcgatcctctggctctccgggagttcaaggaatttgccgctgggagacgctctgtgtccggagacctgatccttgagattggcaaactgccccagcacctcaccctgcgggcccagaacgctctggataatctcgttatgcttcacaacagcgaacaggggggaaaggcctacagacatgcgatggaggaactgccggacacaatcgagaccctgatgctcctggcccttatcgctgtgctgacaggcggcgtgacgctcttctttctgtccgggaagggactgggcaaaacctctattgggctcctttgtgtcacagccagctccgctctgctgtggatggcctctgttgagcctcactggatcgccgctagcattatcctcgaattctttctgatggtgcttctgattcccgagcctgatcggcaacgcaccccccaggacaaccagctcgcgtatgtggtcatcggactgctgttcatgatcctcacagtggccgctaatgaaatgggccttctggagaccacgaagaaagatctggggattggacatgttgccgccgagaaccaccaacacgctaccatgctcgacgtggatctgagacctgcctccgcgtggacactttacgccgtcgctaccacagtgatcacccccatgatgcggcatacgattgaaaatacaaccgccaacatcagcctgacagctattgccaatcaggcggccatcctcatgggcctggacaagggctggccgatttctaaaatggatatcggggtccctctgctcgctcttggatgctactcccaggtgaaccccctgaccctgaccgccgctgttctcatgctggtggcccactatgctatcattggccccgggcttcaggccaaggcgacacgcgaggcccaaaagagaacggctgccggaatcatgaaaaatcctaccgtcgacggcattgtggctatcgatctggacccggttgtgtacgacgccaagtttgaaaaacagctcgggcagattatgctgctgatcctctgtacaagccagatccttctgatgcggaccacatgggccctgtgcgagtctattaccctcgcgacgggacccctgacaaccctttgggaaggctcccctggcaagttctggaacaccacaatcgctgtcagcatggccaatattttccgcgggtcttatctggctggagccggcctcgcctttagcctgatgaaatccctggggggaggcagacgggggaccggagctcaaggcgagacactcggcgagaagtggaagcgccagcttaaccagctgtctaaaagcgaattcaatacgtacaagagatccgggatcatggaggtggatcggagcgaagccaaagagggactgaagagaggcgaaaccacaaaacatgcggtgtcccgcgggaccgccaagctccggtggtttgttgagagaaacctggtcaagcccgagggaaaagtgattgaccttggctgtgggcgcggaggctggtcttattactgcgctggcctgaagaaagtgacagaagtcaaggggtataccaaaggaggccctgggcacgaggaacccatccctatggccacgtacggatggaatctcgttaagctgcatagcggcaaagatgtgttctttatgccgcccgagaagtgtgacaccctgctctgcgatatcggggaatcctctcctaaccccacaattgaggagggacggacccttagagtgctgaagatggtcgaaccttggctgcgcggcaatcagttctgtatcaaaattctcaacccctacatgccgagcgtggttgagacactggaacaaatgcagcggaagcacggcgggatgcttgtgagaaatcctctgtcccgcaactctacccacgagatgtattgggtcagctgcggaacaggcaacatcgtgtccgctgttaatatgaccagccggatgctcctgaacagatttacgatggcccatcgcaaacccacatacgagcgggacgtggatctgggggcgggaaccagacacgtcgccgtggaacccgaggtggctaatctcgacattatcggccagcgcattgaaaacatcaagaatgagcataaatctacctggcactatgatgaagacaacccttacaagacatgggcctatcacgggtcctacgaggtcaagcccagcggatctgcttccagcatggttaatggcgtggtgagactgcttacgaaaccttgggatgtcatcccgatggtgacccaaattgccatgacagacaccacacccttcggccagcagcgggtttttaaggagaaagtggacacccgcacacctagagctaagcgggggaccacgcagatcatggaagtcaccgccaaatggctgtggggattcctctctagaaacaagaagccccggatttgtacacgcgaggaatttaccagaaaagtgcggtccaatgcggccatcggcgctgttttcgtggatgagaaccaatggaatagcgccaaggaagctgtcgaggacgagcgcttttgggatctggtgcatagagaacgggagcttcacaaacaggggaagtgcgccacatgcgtttataacatgatgggaaaacgcgaaaagaagctgggcgagttcgggaaagccaagggctccagagcgatttggtacatgtggctcggagctcggttcctggaatttgaggccctgggcttcatgaatgaggaccattggtttagccgcgaaaactctctcagcggggtggagggagaaggcctgcacaaacttgggtacatcctgagagatatctccaagattcctggaggcaatatgtatgccgacgataccgctgggtgggacacgcggatcacagaggatgacctccagaacgaggccaaaattaccgaaatcatggagcccgaacatgctctgcttgccacatctattttcaagctgacctaccagaacaaagtcgtgcgcgtccaaagaccggcgaagaatggcacggtgatggatgttatcagccggcgcgaccagagaggatccggccaggtggggacctatggactcaacacatttaccaatatggaggtccagctgatccggcaaatggaatctgagggcattttcctgcctagcgagctcgaaacacccaacctggccgagagagtgcttgattggctggaaaagcacggggctgagcgcctcaaacggatggccatctccggagacgactgtgtggttaagcctattgatgacagatttgctaccgccctgacagcgcttaatgatatgggcaaagtgcgcaaggacatcccccagtgggaaccttctaaagggtggaacgattggcagcaggtccccttctgcagccaccattttcaccaactgattatgaaggacggccgggagatcgtggttccgtgtagaaatcaggatgagctcgtgggacgcgcccgggtctcccagggcgctgggtggagcctgagagaaaccgcctgcctgggaaagtcttacgctcaaatgtggcagctcatgtatttccatcgccgggacctgagacttgccgctaacgccatctgttccgcggtgcctgtcgattgggtgcccacgagccgcacaacctggtctattcacgcccaccatcagtggatgaccacagaggacatgctgtccgtttggaatcgggtgtggatcgaagagaacccctggatggaagataaaacccacgtcagctcctgggaggaggtgccttacctcggcaagagagaagaccagtggtgcgggtctctgattggacttacagctcgggccacgtgggccaccaatatccaagttgctattaaccaggtgagacgcctgatcggcaatgagaactatctcgactacatgacaagcatgaaacggtttaagaatgaatccgatccggagggggccctgtggtga
